(12) United States Patent
Yount et al.

(10) Patent No.: US 11,124,547 B2
(45) Date of Patent: Sep. 21, 2021

(54) ANTIMICROBIAL TYPE-II BACTERIOCINS

(71) Applicant: The Lundquist Institute for Biomedical Innovation at Harbor-UCLA Medical Center, Torrance, CA (US)

(72) Inventors: Nannette Y. Yount, San Juan Capistrano, CA (US); Michael R. Yeaman, Redondo Beach, CA (US)

(73) Assignee: THE LUNDQUIST INSTITUTE FOR BIOMEDICAL INNOVATION, Torrance, CA (US)

( * ) Notice: Subject to any disclaimer, the term of this patent is extended or adjusted under 35 U.S.C. 154(b) by 0 days.

(21) Appl. No.: 16/612,245

(22) PCT Filed: May 10, 2018

(86) PCT No.: PCT/US2018/032136
§ 371 (c)(1),
(2) Date: Nov. 8, 2019

(87) PCT Pub. No.: WO2018/209129
PCT Pub. Date: Nov. 15, 2018

(65) Prior Publication Data
US 2020/0123209 A1   Apr. 23, 2020

Related U.S. Application Data

(60) Provisional application No. 62/505,015, filed on May 11, 2017.

(51) Int. Cl.
| | |
|---|---|
| *C07K 14/32* | (2006.01) |
| *G16B 30/10* | (2019.01) |
| *A61K 38/16* | (2006.01) |
| *A61K 45/06* | (2006.01) |
| *C07K 14/195* | (2006.01) |
| *C07K 14/325* | (2006.01) |

(52) U.S. Cl.
CPC ............ *C07K 14/32* (2013.01); *A61K 38/164* (2013.01); *A61K 45/06* (2013.01); *C07K 14/195* (2013.01); *C07K 14/325* (2013.01); *G16B 30/10* (2019.02)

(58) Field of Classification Search
CPC ...... A61K 38/00; A61K 38/14; A61K 38/164; A61K 45/06; C07K 14/195; C07K 14/32; C07K 14/325; G01N 33/50; G06F 7/00; G16B 30/10
See application file for complete search history.

(56) References Cited

U.S. PATENT DOCUMENTS

| | | | |
|---|---|---|---|
| 8,389,679 B2 * | 3/2013 | Eckert ................... | A61P 31/04 530/324 |
| 2010/0129864 A1 | 5/2010 | Stiles et al. | |
| 2011/0039761 A1 | 2/2011 | Eckert et al. | |

OTHER PUBLICATIONS

Challacombe et al. Genome Announcement. The Complete Genome Sequence of Baciullus thurigiensis Al Hakam. Journal of Bacteriology, May 2007, pp. 3680-3681. (Year: 2007).*
Acuña et al., "A new hybrid bacteriocin, Ent35-MccV, displays antimicrobial activity against pathogenic Gram-positive and Gram-negative bacteria", FEBS Open Bio., 2012, vol. 2, pp. 12-19.
GenBank-AEW58258, Hypothetical protein bcf_25825 [Bacillus cereus F837/76] GenBank Accession No. AEW58258, Jan. 30, 2014, retrieved on Jun. 28, 2018, from the Internet: URL:https://www.ncbi.nlm.nih.gov/protein/AEW58258/1?report=genbank&log$=prottop&blast_rank=1&RID=KANPXPVW015.
International Search Report and Written Opinion for PCT/US2018/032136 dated Sep. 10, 2018, 15 pages.
Yang et al. "Antibacterial activities of bacteriocins: application in foods and pharmaceuticals", Front Microbiol., 2014, vol. 5:241, pp. 1-10.

* cited by examiner

*Primary Examiner* — Marcela M Cordero Garcia
(74) *Attorney, Agent, or Firm* — Sheppard Mullin; Alex Y. Nie

(57) ABSTRACT

Computational systems and methods are described for identifying new type-ll bacteriocins using a systemic consensus formula and other related criteria. Newly identified type-ll bacteriocin peptides are tested experimentally and show potent microbicidal activities. Further provided are the sequences of Newly identified type-ll bacteriocin peptides, and a method of treating an infection in a patient in need thereof, comprising administering to the patient an effective amount of a peptide comprising an amino acid sequence disclosed.

10 Claims, 6 Drawing Sheets

Specification includes a Sequence Listing.

ANTIMICROBIAL TYPE-II BACTERIOCINS

CROSS REFERENCE TO RELATED APPLICATIONS

This application is the U.S. national stage application of International Application No. PCT/US2018/032136, filed May 10, 2018, which claims the benefit under 35 U.S.C. § 119(e) of U.S. Provisional Application No. 62/505,015, filed May 11, 2017, the contents of which are incorporated by reference in their entirety into the present disclosure.

SEQUENCE LISTING

The instant application contains a Sequence Listing which has been submitted in ASCII format via EFS-Web and is hereby incorporated by reference in its entirety. Said ASCII copy, created on May 10, 2018, is named 254303WO_ST25.txt and is 608,015 bytes in size.

BACKGROUND

One of the most ancient arms of organismal host defense first arose in prokaryotes as a means to neutralize their competitors. This host defense armamentarium is likely more vast than the known microbial kingdom and is comprised of both ribosomally and non-ribosomally synthesized compounds. Of the ribosomally-synthesized compounds one of the most well characterized groups are the Class II bacteriocins which are synthesized primarily by Gram-positive organisms.

The majority of Class II bacteriocins are initially synthesized as precursors containing a relatively well conserved signal peptide domain. One characteristic feature of this domain, is the presence of a double-glycine motif which occurs just upstream of the signal peptide cleavage site. Processing of the signal peptide has been shown to be carried out by a class of dedicated membrane-bound ABC transporters which are conserved across many bacteriocin-expressing bacterial species.

SUMMARY

It is contemplated that since Class II bacteriocins are processed via a common enzymatic process, most bacteriocin signal peptides contain elements that are conserved with a high degree of fidelity across many family members. As shown in the examples, an analysis of these conserved elements led to the creation of a consensus formula that was representative of a majority of the known class II bacteriocin families. This consensus formula was used a primary screen for previously uncharacterized class II bacteriocin families in online protein databases.

In addition to this conserved consensus, many class II bacteriocins were predicted, and/or shown, to form amphipathic helices when interacting with hydrophobic environments that mimic the microbial plasma membrane. Such amphipathic helices are common to many classes of antimicrobial peptides and are important for their membrane permeabilizing activities. With this discovery, as a means to selectively enrich for antimicrobial compounds, a new amphipathic pattern-search component is disclosed as a component of the search method.

This multi-component search method of the present technology recovered a large number of the known class II bacteriocins from a broad spectrum of organisms. Moreover, the method identified many putative bacteriocin sequences, some from organisms for which no bacteriocin peptides have been identified to date. A number of these putative bacteriocins were synthesized and found to have potent microbicidal activity against a broad spectrum of prototypic Gram-positive, Gram-negative and fungal organisms.

One embodiment of the present disclosure provides a peptide comprising an amino acid sequence selected from the group consisting of FKVIVTDAGHY-PREWGKQLGKWIGSKIK (SEQ ID NO: 5), KRNYSIEKYVKNY1DFIKKAIDIFRPMPI (SEQ ID NO: 6), KTIATNATYYPNKWAKSAGKWIASKIK (SEQ ID NO: 7), QYDKTGYKIGKTVGTIVRKGFEIWSIFK (SEQ ID NO: 8), and an amino acid derived from SEQ ID NO: 5, 6, 7 or 8 with one amino acid substitution, wherein the peptide is not longer than 45 amino acid residues in length.

In some embodiments, the peptide has antimicrobial activity. In some embodiments, the peptide comprises the amino acid sequence of SEQ ID NO: 5, 6, 7, or 8.

In some embodiments, the peptide is not longer than 40 amino acid residues in length. In some embodiments, the peptide is not longer than 35 amino acid residues in length.

Also provided, in one embodiment, is a peptide comprising an amino acid sequence of Table 2 or 3 or SEQ ID NO: 328-1884 or an amino acid derived from a sequence of Table 2 or 3 or SEQ ID NO:328-1884 with one amino acid substitution, wherein the peptide is not longer than 45 amino acid residues in length.

In some embodiments, the peptide includes one or more non-natural amino acid residue.

Also provided, in one embodiment, is a composition comprising the peptide and a pharmaceutically acceptable carrier. In some embodiments, the composition further comprises an antimicrobial agent. In some embodiments, the antimicrobial agent is selected from the group consisting of imipenem, ceftazidime, colistin, chloroquine, artemisinin, vancomycin and daptomycin.

Also provided, in one embodiment, is a method of treating an infection in a patient in need thereof, comprising administering to the patient an effective amount of a peptide comprising an amino acid sequence of Table 2 or 3 or SEQ ID NO:328-1884 or an amino acid derived from a sequence of Table 2 or 3 or SEQ ID NO:328-1884 with one amino acid substitution. In some embodiments, the infection is caused by a Gram-negative bacterium, a Gram-positive bacterium or a fungus.

Yet another embodiment provides a computer-implemented method of identifying a type-II bacteriocin, comprising: searching in a protein database, with one or more processors, for proteins comprising a fragment matching a first consensus formula for type-II bacteriocin; filtering the searched proteins to remove proteins that do not contain an alpha-helical domain; calculating a score for the fragment in each of the searched proteins for one or more parameters selected from hydrophobic moment, mean hydrophobicity, net charge, frequencies or ratio of K and R, or isoelectric point; and identifying a type-II bacteriocin based on the scores.

In some embodiments, the first consensus formula comprises [LI]-[KREDNQSTYH]-X-[KREDNQSTYH]-X-[MLV]-X-X-[IVLT]-X-G-G, wherein X denotes any amino acid.

In some embodiments, the method further comprises searching in the protein database for proteins that match a hidden Markov Model built for type-II bacteriocin.

In some embodiments, the alpha-helical domain is identified with a second consensus formula comprising X-[VILMCFWYAG]-[KRHEDNQSTAG]-[KRHEDNQSTAG]-[VILMCFWYAG]-[VILMCFWYAG]-[KRHEDNQSTAG]-[KRHEDNQSTAG]-[VILMCFWYAG]-X-[KRHEDNQ STAG]-[VILMCFWYAG], wherein X denotes any amino acid residue.

In some embodiments, the parameters comprise hydrophobic moment and isoelectric point. In some embodiments, the search results are limited to proteins that are 80 amino acid residues or fewer in length and containing the fragment within the first 25 amino acid residues.

BRIEF DESCRIPTION OF THE DRAWINGS

Certain features of various embodiments of the present technology are set forth with particularity in the appended claims. A better understanding of the features and advantages of the technology will be obtained by reference to the following detailed description that sets forth illustrative embodiments, in which the principles of the technology are utilized, and the accompanying drawings of which:

DETAILED DESCRIPTION

Figure 1:
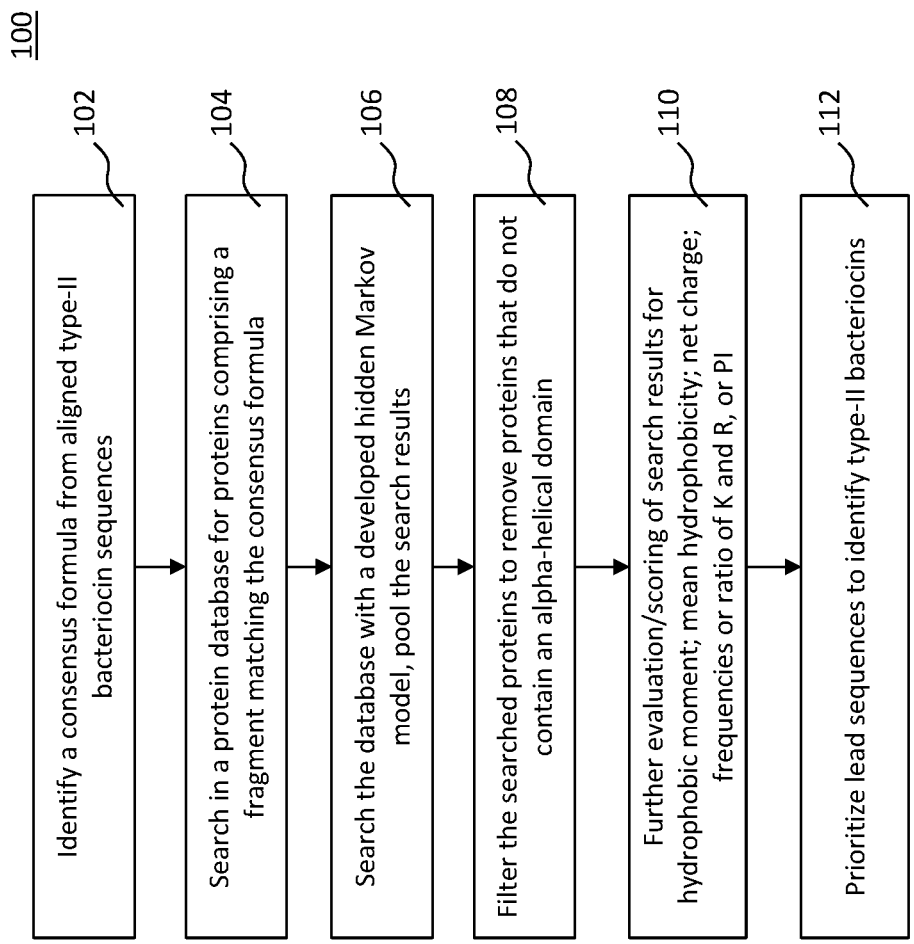
FIG. 1 illustrates an example process flow chart of a method, according to some implementations.

It is to be understood that this disclosure is not limited to particular embodiments described, as such may, of course, vary. It is also to be understood that the terminology used herein is for the purpose of describing particular embodiments only, and is not intended to be limiting, since the scope of the present disclosure will be limited only by the appended claims.

It must be noted that as used herein and in the appended claims, the singular forms "a", "an", and "the" include plural referents unless the context clearly dictates otherwise. Thus, for example, reference to "a peptide" includes a plurality of peptides.

1. Definitions

Unless defined otherwise, all technical and scientific terms used herein have the same meaning as commonly understood by one of ordinary skill in the art to which this disclosure belongs. As used herein the following terms have the following meanings.

As used herein, the term "comprising" or "comprises" is intended to mean that the compositions and methods include the recited elements, but not excluding others. "Consisting essentially of" when used to define compositions and methods, shall mean excluding other elements of any essential significance to the combination for the stated purpose. Thus, a composition consisting essentially of the elements as defined herein would not exclude other materials or steps that do not materially affect the basic and novel characteristic(s) claimed. "Consisting of" shall mean excluding more than trace elements of other ingredients and substantial method steps. Embodiments defined by each of these transition terms are within the scope of this disclosure.

The term "about" when used before a numerical designation, e.g., temperature, time, amount, and concentration, including range, indicates approximations which may vary by (+) or (−) 10%, 5% or 1%.

As used herein, the term "sequence identity" refers to a level of amino acid residue or nucleotide identity between two peptides or between two nucleic acid molecules. When a position in the compared sequence is occupied by the same base or amino acid, then the molecules are identical at that position. A peptide (or a polypeptide or peptide region) has a certain percentage (for example, at least about 60%, or at least about 65%, or at least about 70%, or at least about 75%, or at least about 80%, or at least about 83%, or at least about 85%, or at least about 90%, or at least about 95%, or at least about 98% or at least about 99%) of "sequence identity" to another sequence means that, when aligned, that percentage of bases (or amino acids) are the same in comparing the two sequences. It is noted that, for any sequence ("reference sequence") disclosed in this application, sequences having at least about 60%, or at least about 65%, or at least about 70%, or at least about 75%, or at least about 80%, or at least about 83%, or at least about 85%, or at least about 90%, or at least about 95%, or at least about 98% or at least about 99% sequence identity to the reference sequence are also within the disclosure.

Likewise, the present disclosure also includes sequences that have one, two, three, four, or five substitution, deletion or addition of amino acid residues or nucleotides as compared to the reference sequences.

In any of the embodiments described herein, analogs of a peptide comprising any amino acid sequence described herein are also provided, which have at least about 80%, or at least about 83%, or at least about 85%, or at least about 90%, or at least about 95%, or at least about 98%, or at least about 99% sequence identity to any of reference amino acid sequences. In some embodiments, the analogs include one, two, three, four, or five substitution, deletion or addition of amino acid residues as compared to the reference sequences. In some embodiments, the substitution is a conservative substitution.

As used herein the term "amino acid" refers to either natural and/or unnatural or synthetic amino acids, including glycine and both the D and L optical isomers, amino acid analogs and peptidomimetics. In some embodiments, non-natural amino acids are useful for tuning or engineering the helix or other secondary or tertiary structures of a peptide or protein for desired antimicrobial properties.

As is well-known in the art, a "conservative substitution" of an amino acid or a "conservative substitution variant" of a peptide refers to an amino acid substitution which maintains: 1) the secondary structure of the peptide; 2) the charge or hydrophobicity of the amino acid; and 3) the bulkiness of the side chain or any one or more of these characteristics. Illustratively, the well-known terminologies "hydrophilic residues" relate to serine or threonine. "Hydrophobic residues" refer to leucine, isoleucine, phenylalanine, valine or alanine, or the like. "Positively charged residues" relate to lysine, arginine, ornithine, or histidine. "Negatively charged residues" refer to aspartic acid or glutamic acid. Residues having "bulky side chains" refer to phenylalanine, tryptophan or tyrosine, or the like. A list of illustrative conservative amino acid substitutions is given in Table A.

TABLE A

| For Amino Acid | Replace With |
| --- | --- |
| Alanine | D-Ala, Gly, Aib, β-Ala, L-Cys, D-Cys |
| Arginine | D-Arg, Lys, D-Lys, Orn D-Orn |
| Asparagine | D-Asn, Asp, D-Asp, Glu, D-Glu Gln, D-Gln |
| Aspartic Acid | D-Asp, D-Asn, Asn, Glu, D-Glu, Gln, D-Gln |
| Cysteine | D-Cys, S-Me-Cys, Met, D-Met, Thr, D-Thr, L-Ser, D-Ser |
| Glutamine | D-Gln, Asn, D-Asn, Glu, D-Glu, Asp, D-Asp |
| Glutamic Acid | D-Glu, D-Asp, Asp, Asn, D-Asn, Gln, D-Gln |
| Glycine | Ala, D-Ala, Pro, D-Pro, Aib, β-Ala |
| Isoleucine | D-Ile, Val, D-Val, Leu, D-Leu, Met, D-Met |
| Leucine | Val, D-Val, Met, D-Met, D-Ile, D-Leu, Ile |
| Lysine | D-Lys, Arg, D-Arg, Orn, D-Orn |
| Methionine | D-Met, S-Me-Cys, Ile, D-Ile, Leu, D-Leu, Val, D-Val |
| Phenylalanine | D-Phe, Tyr, D-Tyr, His, D-His, Trp, D-Trp |
| Proline | D-Pro |
| Serine | D-Ser, Thr, D-Thr, allo-Thr, L-Cys, D-Cys |
| Threonine | D-Thr, Ser, D-Ser, allo-Thr, Met, D-Met, Val, D-Val |
| Tyrosine | D-Tyr, Phe, D-Phe, His, D-His, Trp, D-Trp |
| Valine | D-Val, Leu, D-Leu, Ile, D-Ile, Met, D-Met |

Alternatively, non-limiting examples of conservative amino acid substitutions are provided in Table B below, where a similarity score of 0 or higher indicates conservative substitution between the two amino acids.

TABLE B

|   | C | G | P | S | A | T | D | E | N | Q | H | K | R | V | M | I | L | F | Y | W |
| --- | --- | --- | --- | --- | --- | --- | --- | --- | --- | --- | --- | --- | --- | --- | --- | --- | --- | --- | --- | --- |
| W | −8 | −7 | −6 | −2 | −6 | −5 | −7 | −7 | −4 | −5 | −3 | −3 | 2 | −6 | −4 | −5 | −2 | 0 | 0 | 17 |
| Y | 0 | −5 | −5 | −3 | −3 | −3 | −4 | −4 | −2 | −4 | 0 | −4 | −5 | −2 | −2 | −1 | −1 | 7 | 10 | |
| F | −4 | −5 | −5 | −3 | −4 | −3 | −6 | −5 | −4 | −5 | −2 | −5 | −4 | −1 | 0 | 1 | 2 | 9 | | |
| L | −6 | −4 | −3 | −3 | −2 | −2 | −4 | −3 | −3 | −2 | −2 | −3 | −3 | 2 | 4 | 2 | 6 | | | |
| I | −2 | −3 | −2 | −1 | −1 | 0 | −2 | −2 | −2 | −2 | −2 | −2 | −2 | 4 | 2 | 5 | | | | |
| M | −5 | −3 | −2 | −2 | −1 | −1 | −3 | −2 | 0 | −1 | −2 | 0 | 0 | 2 | 6 | | | | | |
| V | −2 | −1 | −1 | −1 | 0 | 0 | −2 | −2 | −2 | −2 | −2 | −2 | −2 | 4 | | | | | | |
| R | −4 | −3 | 0 | 0 | −2 | −1 | −1 | −1 | 0 | 1 | 2 | 3 | 6 | | | | | | | |
| K | −5 | −2 | −1 | 0 | −1 | 0 | 0 | 0 | 1 | 1 | 0 | 5 | | | | | | | | |
| H | −3 | −2 | 0 | −1 | −1 | −1 | 1 | 1 | 2 | 3 | 6 | | | | | | | | | |
| Q | −5 | −1 | 0 | −1 | 0 | −1 | 2 | 2 | 1 | 4 | | | | | | | | | | |
| N | −4 | 0 | −1 | 1 | 0 | 0 | 2 | 1 | 2 | | | | | | | | | | | |
| E | −5 | 0 | −1 | 0 | 0 | 0 | 3 | 4 | | | | | | | | | | | | |
| D | −5 | 1 | −1 | 0 | 0 | 0 | 4 | | | | | | | | | | | | | |
| T | −2 | 0 | 0 | 1 | 1 | 3 | | | | | | | | | | | | | | |
| A | −2 | 1 | 1 | 1 | 2 | | | | | | | | | | | | | | | |
| S | 0 | 1 | 1 | 1 | | | | | | | | | | | | | | | | |
| P | −3 | −1 | 6 | | | | | | | | | | | | | | | | | |
| G | −3 | 5 | | | | | | | | | | | | | | | | | | |
| C | 12 | | | | | | | | | | | | | | | | | | | |

Alternatively, non-limiting examples of conservative amino acid substitutions include substitutions of a polar amino acid with a different polar amino acid, or substitutions of a hydrophobic amino acid with a different hydrophobic amino acid, as illustrated in Table C below. Each of the polar amino acids or hydrophobic amino acids, in some embodiments, can be substituted with Ala or Gly.

TABLE C

| | |
|---|---|
| Polar amino acids | K, R, H, E, D, N, Q, S, T (or substituted with A or G) |
| Hydrophobic amino acids | V, I, L, M, C, F, W, Y (or substituted with A or G) |

As used herein, the term "composition" refers to a preparation suitable for administration to an intended patient for therapeutic purposes that contains at least one pharmaceutically active ingredient, including any solid form thereof. The composition may include at least one pharmaceutically acceptable component to provide an improved formulation of the compound, such as a suitable carrier. In certain embodiments, the composition is formulated as a film, gel, patch, or liquid solution.

As used herein, the term "pharmaceutically acceptable" indicates that the indicated material does not have properties that would cause a reasonably prudent medical practitioner to avoid administration of the material to a patient, taking into consideration the disease or conditions to be treated and the respective route of administration. For example, it is commonly required that such a material be essentially sterile.

2. Antimicrobial Type II Bacteriocins

The present disclosure, in some embodiments, describes a computational approach for generating a systemic formula and related procedure to screen for new antimicrobial type-II bacteriocins. The identified protein and peptide families and their specific sequences are provided in Tables 2 and 3 and the appended Sequence Listing (SEQ ID NO:1-8, 9-327 and 328-1884). In some embodiments, provided is an isolated peptide comprising an amino acid sequence of Table 2 or 3 or the appended Sequence Listing (SEQ ID NO:1-1884) or an amino acid derived therefrom with one, two or three amino acid substitution. In some embodiments, the substitution is a conservative substitution. In some embodiments, the substitution is the replacement of a polar amino acid with a different polar amino acid, or the replacement of a hydrophobic amino acid with a different hydrophobic amino acid.

In some embodiments, provided is an isolated peptide comprising an amino acid sequence selected from the group consisting of EWGKQLGKWIGSKIK (SEQ ID NO: 1), KYVKNYLDFIKKAIDIFRPMPI (SEQ ID NO: 2), KWAKSAGKWIASKIK (SEQ ID NO: 3), KIGKTVGTIVRKGFEIWSIFK (SEQ ID NO: 4), and an amino acid derived from SEQ ID NO: 1, 2, 3 or 4 with one, two or three amino acid substitution. In some embodiments, the peptide comprises an amino acid sequence selected from the group consisting of FKVIVTDAGHYPREWGKQLGKWIGSKIK (SEQ ID NO: 5), KRNYSIEKYVKNY1DFIKKAIDIFRPMPI (SEQ ID NO: 6), KTIATNATYYPNKWAKSAGKWIASKIK (SEQ ID NO: 7), QYDKTGYKIGKTVGTIVRKGFEIWSIFK (SEQ ID NO: 8), and an amino acid derived from SEQ ID NO: 5, 6, 7, or 8 with one amino acid substitution. In some embodiments, the substitution is a conservative substitution.

In some embodiments, the substitution is the replacement of a polar amino acid with a different polar amino acid, or the replacement of a hydrophobic amino acid with a different hydrophobic amino acid.

In some embodiments, the peptide is a fragment or fusion peptide described from natural proteins. In some embodiments, the peptide differs from natural proteins by at least an amino acid substation, addition or deletion.

In some embodiments, the peptide is not longer than 100 amino acid residues in length. In some embodiments, the peptide is not longer than 95, 90, 85, 80, 75, 70, 65, 60, 55, 50, 45, 40, 35, 30 or 25 amino acid resides in length. In some embodiments, the peptide has antimicrobial activity.

In some embodiments, the peptide has antimicrobial activity. In some embodiments, the peptides may be conjugated to therapeutic agents, prodrugs, peptides, proteins, enzymes, viruses, lipids, biological response modifiers, pharmaceutical agents, or PEG.

The peptides may be conjugated or fused to a therapeutic agent, which may include detectable labels such as radioactive labels, an immunomodulator, a hormone, an enzyme, an oligonucleotide, a photoactive therapeutic or diagnostic agent, a cytotoxic agent, which may be a drug or a toxin, an ultrasound enhancing agent, a non-radioactive label, a combination thereof and other such agents known in the art. The peptides can be detectably labeled by coupling it to a chemiluminescent compound. The presence of the chemiluminescent-tagged antigen-binding polypeptide is then determined by detecting the presence of luminescence that arises during the course of a chemical reaction. Examples of particularly useful chemiluminescent labeling compounds are luminol, isoluminol, theromatic acridinium ester, imidazole, acridinium salt and oxalate ester.

3. Synthesis of Antimicrobial Peptides

The peptides described herein can be ordered from a commercial source or partially or fully synthesized using methods well known in the art (e.g., chemical and/or biotechnological methods). In certain embodiments, the peptides are synthesized according to solid phase peptide synthesis protocols that are well known in the art. In another embodiment, the peptide is synthesized on a solid support according to the well-known Fmoc protocol, cleaved from the support with trifluoroacetic acid and purified by chromatography according to methods known to persons skilled in the art. In other embodiments, the peptide is synthesized utilizing the methods of biotechnology that are well known to persons skilled in the art. In one embodiment, a DNA sequence that encodes the amino acid sequence information for the desired peptide is ligated by recombinant DNA techniques known to persons skilled in the art into an expression plasmid (for example, a plasmid that incorporates an affinity tag for affinity purification of the peptide), the plasmid is transfected into a host organism for expression, and the peptide is then isolated from the host organism or the growth medium, e.g., by affinity purification.

The peptides can be also prepared by using recombinant expression systems. Generally, this involves inserting the nucleic acid molecule into an expression system to which the molecule is heterologous (i.e., not normally present). One or more desired nucleic acid molecules encoding a peptide of the disclosure may be inserted into the vector. When multiple nucleic acid molecules are inserted, the multiple nucleic acid molecules may encode the same or different peptides. The heterologous nucleic acid molecule is inserted into the expression system or vector in proper sense (5'→3') orientation relative to the promoter and any other 5' regulatory molecules, and correct reading frame.

Purified peptides may be obtained by several methods. The peptide is preferably produced in purified form (preferably at least about 80% or 85% pure, more preferably at least about 90% or 95% pure) by conventional techniques. Depending on whether the recombinant host cell is made to secrete the peptide into growth medium (see U.S. Pat. No. 6,596,509 to Bauer et al., which is hereby incorporated by reference in its entirety), the peptide can be isolated and purified by centrifugation (to separate cellular components from supernatant containing the secreted peptide) followed by sequential ammonium sulfate precipitation of the supernatant. The fraction containing the peptide is subjected to gel filtration in an appropriately sized dextran or polyacrylamide column to separate the peptides from other proteins. If necessary, the peptide fraction may be further purified by HPLC.

4. Antimicrobial Compositions and Formulations

Compositions and formulations that include any one or more of the peptides as disclosed herein are also provided. In one embodiment, the composition includes any one or more of the peptides and a pharmaceutically acceptable carrier.

"Pharmaceutically acceptable carriers" refers to any diluents, excipients, or carriers that may be used in the compositions of the disclosure. Pharmaceutically acceptable carriers include ion exchangers, alumina, aluminum stearate, lecithin, serum proteins, such as human serum albumin, buffer substances, such as phosphates, glycine, sorbic acid, potassium sorbate, partial glyceride mixtures of saturated vegetable fatty acids, water, salts or electrolytes, such as protamine sulfate, disodium hydrogen phosphate, potassium hydrogen phosphate, sodium chloride, zinc salts, colloidal silica, magnesium trisilicate, polyvinyl pyrrolidone, cellulose-based substances, polyethylene glycol, sodium carboxymethylcellulose, polyacrylates, waxes, polyethylene-polyoxypropylene-block polymers, polyethylene glycol and wool fat. Suitable pharmaceutical carriers are described in *Remington's Pharmaceutical Sciences*, Mack Publishing Company, a standard reference text in this field. They are preferably selected with respect to the intended form of administration, that is, oral tablets, capsules, elixirs, syrups and the like, and consistent with conventional pharmaceutical practices.

The pharmaceutical compositions of the disclosure can be manufactured by methods well known in the art such as conventional granulating, mixing, dissolving, encapsulating, lyophilizing, or emulsifying processes, among others. Compositions may be produced in various forms, including granules, precipitates, or particulates, powders, including freeze dried, rotary dried or spray dried powders, amorphous powders, injections, emulsions, elixirs, suspensions or solutions. Formulations may optionally contain stabilizers, pH modifiers, surfactants, bioavailability modifiers and combinations of these.

Pharmaceutical formulations may be prepared as liquid suspensions or solutions using a sterile liquid, such as oil, water, alcohol, and combinations thereof. Pharmaceutically suitable surfactants, suspending agents or emulsifying agents, may be added for oral or parenteral administration. Suspensions may include oils, such as peanut oil, sesame oil, cottonseed oil, corn oil and olive oil. Suspension preparation may also contain esters of fatty acids, such as ethyl oleate, isopropyl myristate, fatty acid glycerides and acetylated fatty acid glycerides. Suspension formulations may include alcohols, such as ethanol, isopropyl alcohol, hexadecyl alcohol, glycerol and propylene glycol. Ethers, such as poly(ethyleneglycol), petroleum hydrocarbons, such as mineral oil and petrolatum, and water may also be used in suspension formulations.

The compositions of this disclosure are formulated for pharmaceutical administration to a mammal, preferably a human being. Such pharmaceutical compositions of the disclosure may be administered in a variety of ways, preferably parenterally.

Sterile injectable forms of the compositions of this disclosure may be aqueous or oleaginous suspension. These suspensions may be formulated according to techniques known in the art using suitable dispersing or wetting agents and suspending agents. The sterile injectable preparation may also be a sterile injectable solution or suspension in a non-toxic parenterally acceptable diluent or solvent, for example as a solution in 1,3-butanediol. Among the acceptable vehicles and solvents that may be employed are water, Ringer's solution and isotonic sodium chloride solution. In addition, sterile, fixed oils are conventionally employed as a solvent or suspending medium. For this purpose, any bland fixed oil may be employed including synthetic mono- or di-glycerides. Fatty acids, such as oleic acid and its glyceride derivatives are useful in the preparation of injectables, as are natural pharmaceutically-acceptable oils, such as olive oil or castor oil, especially in their polyoxyethylated versions. These oil solutions or suspensions may also contain a long-chain alcohol diluent or dispersant, such as carboxymethyl cellulose or similar dispersing agents which are commonly used in the formulation of pharmaceutically acceptable dosage forms including emulsions and suspensions. Other commonly used surfactants, such as Tweens, Spans and other emulsifying agents or bioavailability enhancers which are commonly used in the manufacture of pharmaceutically acceptable solid, liquid, or other dosage forms may also be used for the purposes of formulation. Compounds may be formulated for parenteral administration by injection such as by bolus injection or continuous infusion. A unit dosage form for injection may be in ampoules or in multi-dose containers.

In addition to dosage forms described above, pharmaceutically acceptable excipients and carriers and dosage forms are generally known to those skilled in the art and are included in the disclosure. It should be understood that a specific dosage and treatment regimen for any particular patient will depend upon a variety of factors, including the activity of the specific peptide employed, the age, body weight, general health, sex and diet, renal and hepatic function of the patient, and the time of administration, rate of excretion, drug combination, judgment of the treating physician or veterinarian and severity of the particular disease being treated.

In some embodiments, the composition can further include a secondary antimicrobial agent. Non-limiting examples of such agents include imipenem, ceftazidime, colistin, chloroquine, artemisinin, vancomycin and daptomycin.

5. Therapeutic Methods

Methods of using the peptides, compositions and formulations of the present disclosure are also described. In one embodiment, the methods are for preventing or treating an infection of a microorganism. The microorganism can be a bacterium, such as a Gram-negative bacterium or a Gram-positive bacterium, a fungus, or a parasite.

The peptides, compositions and formulations are also useful for treating a disease or condition associated with an infection, such as wound abscess, catheter biofilm, pneumonia, and bacteremia.

In some embodiments, the treatment methods further include administration, concurrently or sequentially, of a second secondary antimicrobial agent. Non-limiting examples of such agents include imipenem, ceftazidime, colistin, chloroquine, artemisinin, vancomycin and daptomycin.

The peptides, compositions and formulations of the disclosure may be administered to the systemic circulation via parental administration. The term "parenteral" as used herein includes subcutaneous, intravenous, intramuscular, intra-articular, intra-synovial, intrasternal, intrathecal, intrahepatic, intralesional and intracranial injection or infusion techniques. However, in cases where the infection is local (e.g., on the skin), the composition may be administered locally, such as topically.

6. Computational System and Methods

The present disclosure, in some embodiments, provides computer-implemented methods for identifying antimicrobial sequences and related systems and non-transitory computer-readable media. In one embodiment, a computer-implemented method of identifying a type-II bacteriocin is provided, as illustrated in FIG. 1 which is a process flow chart of a method 100. The various processing operations and/or data flows depicted in FIG. 1 (and in the other drawing figures) are described in greater detail herein. The described operations may be accomplished using some or all of the system components described in detail above and, in some implementations, various operations may be performed in different sequences and various operations may be omitted. Additional operations may be performed along with some or all of the operations shown in the depicted flow diagrams. One or more operations may be performed simultaneously. Accordingly, the operations as illustrated (and described in greater detail below) are exemplary by nature and, as such, should not be viewed as limiting.

In one embodiment, provided is a computer-implemented method of identifying a type-II bacteriocin. Optionally, at the first step, the method entails identifying a consensus formula from aligned type-II bacteriocin sequences (step 102). In a preferred embodiment, the consensus formula is not stringent so that more search results will be returned, which can be further filtered or screened. In some embodiment, the consensus formula comprises [LI]-[KREDNQSTYH]-X-[KREDNQSTYH]-X-[MLV]-X-X-[IVLT]-X-G-G, wherein X denotes any amino acid.

At step 104, the system or method searches in a protein database for proteins comprising a fragment matching the consensus formula for type-II bacteriocin (step 104). The protein database can be any database, data file, or data source that includes protein sequences. There are a number of publicly accessible protein databases available online. Matching a sequence to a formula can be done with methods known in the art.

At step 106, optionally, a hidden Markov model which can be developed based on known type-II bacteriocin sequences, can be used to search the database (step 106), in particular for unknown sequences. Methods of developing hidden Markov models and using them for sequence searches are known in the art. The search results from the hidden Markov model-based search can be pooled to the first search result.

It is the discovered herein that alpha-helical domain frequently co-exists with type-II bacteriocin domains in proteins. In some embodiments, accordingly, the search results are filtered to remove proteins that do not contain an alpha-helical domain (step 108). For instance, the alpha-helical domains can be identified with a consensus formula comprising X-[VILMCFWYAG]-[KRHEDNQ STAG]-[KRHEDNQSTAG]-[VILMCFWYAG]-[VILMCFWYAG]-[KRHEDNQ STAG]-[KRHEDNQ STAG]-[VILMCFWYAG]-X-[KRHEDNQSTAG]-[VILMCFWYAG], wherein X denotes any amino acid residue.

At step 110, optimally, a score can be calculated for the search results based on one or more parameters selected from hydrophobic moment, mean hydrophobicity, net charge, frequencies or ratio of K and R, or isoelectric point (step 110). In some embodiments, at least the hydrophobic moment is calculated. In some embodiments, at least the isoelectric point is calculated. In some embodiments, at least hydrophobic moment and isoelectric point are calculated, which can be optionally used for prioritizing, ranking, or selecting suitable type-II bacteriocins from the search results (step 112). Although not shown in FIG. 1, the selected type-II bacteriocins can be synthesized and tested in the lab.

Figure 6:
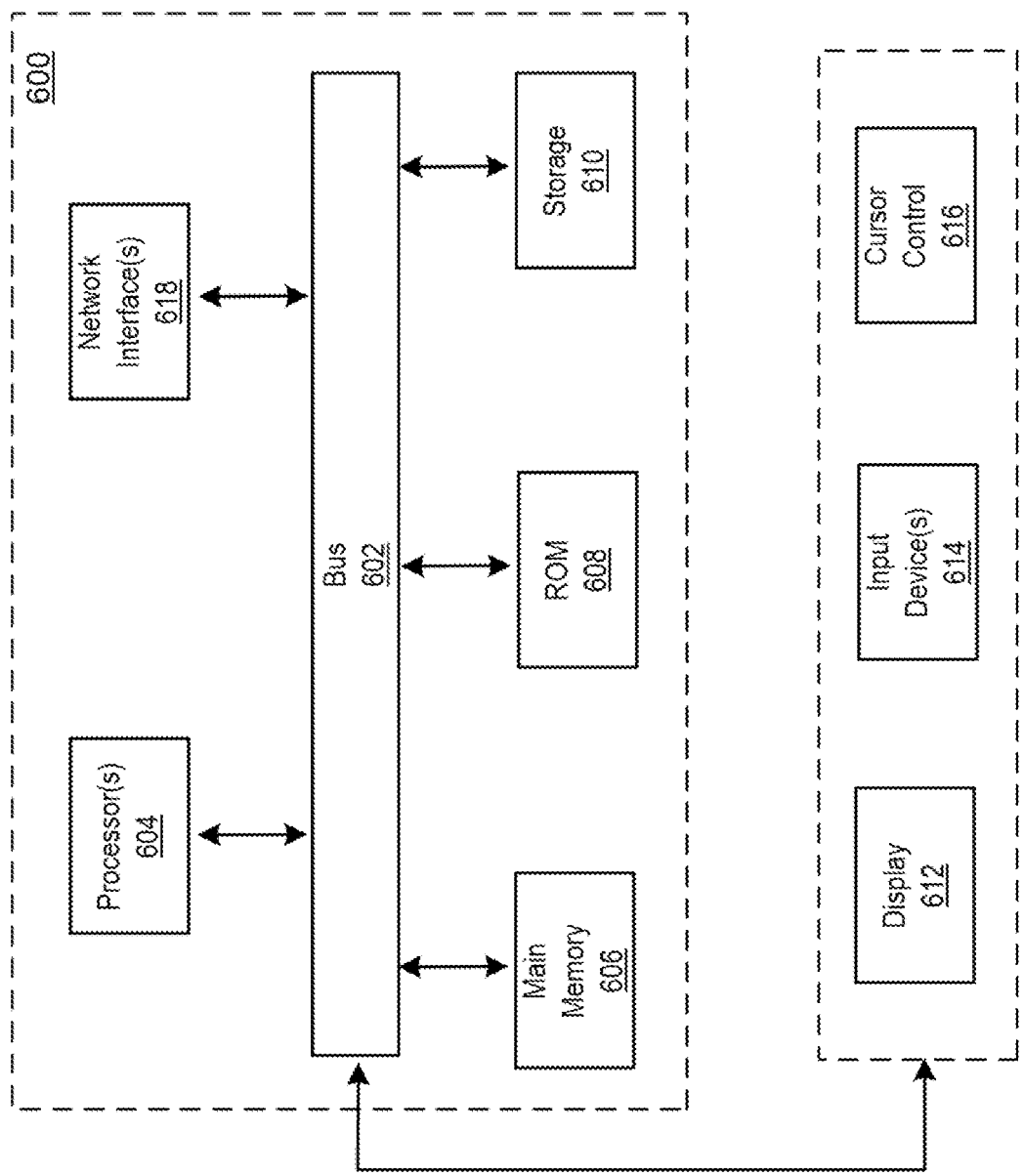
FIG. 6 illustrates a block diagram of an example computer system in which any of the implementations described herein may be implemented.

FIG. 6 depicts a block diagram of an example computer system 600 in which any of the embodiments described herein may be implemented. The computer system 600 includes a bus 602 or other communication mechanism for communicating information, one or more hardware processors 604 coupled with bus 602 for processing information. Hardware processor(s) 604 may be, for example, one or more general purpose microprocessors.

The computer system 600 also includes a main memory 606, such as a random access memory (RAM), cache and/or other dynamic storage devices, coupled to bus 602 for storing information and instructions to be executed by processor 604. Main memory 606 also may be used for storing temporary variables or other intermediate information during execution of instructions to be executed by processor 604. Such instructions, when stored in storage media accessible to processor 604, render computer system 600 into a special-purpose machine that is customized to perform the operations specified in the instructions.

The computer system 600 further includes a read only memory (ROM) 608 or other static storage device coupled to bus 602 for storing static information and instructions for processor 604. A storage device 610, such as a magnetic disk, optical disk, or USB thumb drive (Flash drive), etc., is provided and coupled to bus 602 for storing information and instructions.

The computer system 600 may be coupled via bus 602 to a display 612, such as a cathode ray tube (CRT) or LCD display (or touch screen), for displaying information to a computer user. An input device 614, including alphanumeric and other keys, is coupled to bus 602 for communicating information and command selections to processor 604. Another type of user input device is cursor control 616, such as a mouse, a trackball, or cursor direction keys for communicating direction information and command selections to processor 604 and for controlling cursor movement on display 612. This input device typically has two degrees of freedom in two axes, a first axis (e.g., x) and a second axis (e.g., y), that allows the device to specify positions in a plane. In some embodiments, the same direction information and command selections as cursor control may be implemented via receiving touches on a touch screen without a cursor.

The computing system 600 may include a user interface module to implement a GUI that may be stored in a mass storage device as executable software codes that are executed by the computing device(s). This and other modules may include, by way of example, components, such as software components, object-oriented software components, class components and task components, processes, functions, attributes, procedures, subroutines, segments of program code, drivers, firmware, microcode, circuitry, data, databases, data structures, tables, arrays, and variables.

In general, the word "module," as used herein, refers to logic embodied in hardware or firmware, or to a collection of software instructions, possibly having entry and exit points, written in a programming language, such as, for example, Java, C or C++. A software module may be compiled and linked into an executable program, installed in a dynamic link library, or may be written in an interpreted programming language such as, for example, BASIC, Perl, or Python. It will be appreciated that software modules may be callable from other modules or from themselves, and/or may be invoked in response to detected events or interrupts. Software modules configured for execution on computing devices may be provided on a computer readable medium, such as a compact disc, digital video disc, flash drive, magnetic disc, or any other tangible medium, or as a digital download (and may be originally stored in a compressed or installable format that requires installation, decompression or decryption prior to execution). Such software code may be stored, partially or fully, on a memory device of the executing computing device, for execution by the computing device. Software instructions may be embedded in firmware, such as an EPROM. It will be further appreciated that hardware modules may be comprised of connected logic units, such as gates and flip-flops, and/or may be comprised of programmable units, such as programmable gate arrays or processors. The modules or computing device functionality described herein are preferably implemented as software modules, but may be represented in hardware or firmware. Generally, the modules described herein refer to logical modules that may be combined with other modules or divided into sub-modules despite their physical organization or storage.

The computer system 600 may implement the techniques described herein using customized hard-wired logic, one or more ASICs or FPGAs, firmware and/or program logic which in combination with the computer system causes or programs computer system 600 to be a special-purpose machine. According to one embodiment, the techniques herein are performed by computer system 600 in response to processor(s) 604 executing one or more sequences of one or more instructions contained in main memory 606. Such instructions may be read into main memory 606 from another storage medium, such as storage device 610. Execution of the sequences of instructions contained in main memory 606 causes processor(s) 604 to perform the process steps described herein. In alternative embodiments, hard-wired circuitry may be used in place of or in combination with software instructions.

The term "non-transitory media," and similar terms, as used herein refers to any media that store data and/or instructions that cause a machine to operate in a specific fashion. Such non-transitory media may comprise non-volatile media and/or volatile media. Non-volatile media includes, for example, optical or magnetic disks, such as storage device 610. Volatile media includes dynamic memory, such as main memory 606. Common forms of non-transitory media include, for example, a floppy disk, a flexible disk, hard disk, solid state drive, magnetic tape, or any other magnetic data storage medium, a CD-ROM, any other optical data storage medium, any physical medium with patterns of holes, a RAM, a PROM, and EPROM, a FLASH-EPROM, NVRAM, any other memory chip or cartridge, and networked versions of the same.

Non-transitory media is distinct from but may be used in conjunction with transmission media. Transmission media participates in transferring information between non-transitory media. For example, transmission media includes coaxial cables, copper wire and fiber optics, including the wires that comprise bus 602. Transmission media can also take the form of acoustic or light waves, such as those generated during radio-wave and infra-red data communications.

Various forms of media may be involved in carrying one or more sequences of one or more instructions to processor 604 for execution. For example, the instructions may initially be carried on a magnetic disk or solid state drive of a remote computer. The remote computer can load the instructions into its dynamic memory and send the instructions over a telephone line using a modem. A modem local to computer system 600 can receive the data on the telephone line and use an infra-red transmitter to convert the data to an infra-red signal. An infra-red detector can receive the data carried in the infra-red signal and appropriate circuitry can place the data on bus 602. Bus 602 carries the data to main memory 606, from which processor 604 retrieves and executes the instructions. The instructions received by main memory 606 may retrieves and executes the instructions. The instructions received by main memory 606 may optionally be stored on storage device 610 either before or after execution by processor 604.

The computer system 600 also includes a communication interface 618 coupled to bus 602. Communication interface 618 provides a two-way data communication coupling to one or more network links that are connected to one or more local networks. For example, communication interface 618 may be an integrated services digital network (ISDN) card, cable modem, satellite modem, or a modem to provide a data communication connection to a corresponding type of telephone line. As another example, communication interface 618 may be a local area network (LAN) card to provide a data communication connection to a compatible LAN (or WAN component to communicated with a WAN). Wireless links may also be implemented. In any such implementation, communication interface 618 sends and receives electrical, electromagnetic or optical signals that carry digital data streams representing various types of information.

A network link typically provides data communication through one or more networks to other data devices. For example, a network link may provide a connection through local network to a host computer or to data equipment operated by an Internet Service Provider (ISP). The ISP in turn provides data communication services through the world wide packet data communication network now commonly referred to as the "Internet". Local network and Internet both use electrical, electromagnetic or optical signals that carry digital data streams. The signals through the various networks and the signals on network link and through communication interface 618, which carry the digital data to and from computer system 600, are example forms of transmission media.

The computer system 600 can send messages and receive data, including program code, through the network(s), network link and communication interface 618. In the Internet example, a server might transmit a requested code for an application program through the Internet, the ISP, the local network and the communication interface 618.

The received code may be executed by processor 604 as it is received, and/or stored in storage device 610, or other non-volatile storage for later execution.

Each of the processes, methods, and algorithms described in the preceding sections may be embodied in, and fully or partially automated by, code modules executed by one or more computer systems or computer processors comprising computer hardware. The processes and algorithms may be implemented partially or wholly in application-specific circuitry.

The various features and processes described above may be used independently of one another, or may be combined in various ways. All possible combinations and sub-combinations are intended to fall within the scope of this disclosure. In addition, certain method or process blocks may be omitted in some implementations. The methods and processes described herein are also not limited to any particular sequence, and the blocks or states relating thereto can be performed in other sequences that are appropriate. For example, described blocks or states may be performed in an order other than that specifically disclosed, or multiple blocks or states may be combined in a single block or state. The example blocks or states may be performed in serial, in parallel, or in some other manner. Blocks or states may be added to or removed from the disclosed example embodiments. The example systems and components described herein may be configured differently than described. For example, elements may be added to, removed from, or rearranged compared to the disclosed example embodiments.

Conditional language, such as, among others, "can," "could," "might," or "may," unless specifically stated otherwise, or otherwise understood within the context as used, is generally intended to convey that certain embodiments include, while other embodiments do not include, certain features, elements and/or steps. Thus, such conditional language is not generally intended to imply that features, elements and/or steps are in any way required for one or more embodiments or that one or more embodiments necessarily include logic for deciding, with or without user input or prompting, whether these features, elements and/or steps are included or are to be performed in any particular embodiment.

Any process descriptions, elements, or blocks in the flow diagrams described herein and/or depicted in the attached figures should be understood as potentially representing modules, segments, or portions of code which include one or more executable instructions for implementing specific logical functions or steps in the process. Alternate implementations are included within the scope of the embodiments described herein in which elements or functions may be deleted, executed out of order from that shown or discussed, including substantially concurrently or in reverse order, depending on the functionality involved, as would be understood by those skilled in the art.

It should be emphasized that many variations and modifications may be made to the above-described embodiments, the elements of which are to be understood as being among other acceptable examples. All such modifications and variations are intended to be included herein within the scope of this disclosure. The foregoing description details certain embodiments of the invention. It will be appreciated, however, that no matter how detailed the foregoing appears in text, the invention can be practiced in many ways. As is also stated above, it should be noted that the use of particular terminology when describing certain features or aspects of the invention should not be taken to imply that the terminology is being re-defined herein to be restricted to including any specific characteristics of the features or aspects of the invention with which that terminology is associated. The scope of the invention should therefore be construed in accordance with the appended claims and any equivalents thereof.

Engines, Components, and Logic

Certain embodiments are described herein as including logic or a number of components, engines, or mechanisms. Engines may constitute either software engines (e.g., code embodied on a machine-readable medium) or hardware engines. A "hardware engine" is a tangible unit capable of performing certain operations and may be configured or arranged in a certain physical manner. In various example embodiments, one or more computer systems (e.g., a standalone computer system, a client computer system, or a server computer system) or one or more hardware engines of a computer system (e.g., a processor or a group of processors) may be configured by software (e.g., an application or application portion) as a hardware engine that operates to perform certain operations as described herein.

In some embodiments, a hardware engine may be implemented mechanically, electronically, or any suitable combination thereof. For example, a hardware engine may include dedicated circuitry or logic that is permanently configured to perform certain operations. For example, a hardware engine may be a special-purpose processor, such as a Field-Programmable Gate Array (FPGA) or an Application Specific Integrated Circuit (ASIC). A hardware engine may also include programmable logic or circuitry that is temporarily configured by software to perform certain operations. For example, a hardware engine may include software executed by a general-purpose processor or other programmable processor. Once configured by such software, hardware engines become specific machines (or specific components of a machine) uniquely tailored to perform the configured functions and are no longer general-purpose processors. It will be appreciated that the decision to implement a hardware engine mechanically, in dedicated and permanently configured circuitry, or in temporarily configured circuitry (e.g., configured by software) may be driven by cost and time considerations.

Accordingly, the phrase "hardware engine" should be understood to encompass a tangible entity, be that an entity that is physically constructed, permanently configured (e.g., hardwired), or temporarily configured (e.g., programmed) to operate in a certain manner or to perform certain operations described herein. As used herein, "hardware-implemented engine" refers to a hardware engine. Considering embodiments in which hardware engines are temporarily configured (e.g., programmed), each of the hardware engines need not be configured or instantiated at any one instance in time. For example, where a hardware engine comprises a general-purpose processor configured by software to become a special-purpose processor, the general-purpose processor may be configured as respectively different special-purpose processors (e.g., comprising different hardware engines) at different times. Software accordingly configures a particular processor or processors, for example, to constitute a particular hardware engine at one instance of time and to constitute a different hardware engine at a different instance of time.

Hardware engines can provide information to, and receive information from, other hardware engines. Accordingly, the described hardware engines may be regarded as being communicatively coupled. Where multiple hardware engines exist contemporaneously, communications may be achieved through signal transmission (e.g., over appropriate circuits and buses) between or among two or more of the hardware engines. In embodiments in which multiple hardware engines are configured or instantiated at different times, communications between such hardware engines may be achieved, for example, through the storage and retrieval of information in memory structures to which the multiple hardware engines have access. For example, one hardware engine may perform an operation and store the output of that operation in a memory device to which it is communicatively coupled. A further hardware engine may then, at a later time, access the memory device to retrieve and process the stored output. Hardware engines may also initiate communications with input or output devices, and can operate on a resource (e.g., a collection of information).

The various operations of example methods described herein may be performed, at least partially, by one or more processors that are temporarily configured (e.g., by software) or permanently configured to perform the relevant operations. Whether temporarily or permanently configured, such processors may constitute processor-implemented engines that operate to perform one or more operations or functions described herein. As used herein, "processor-implemented engine" refers to a hardware engine implemented using one or more processors.

Similarly, the methods described herein may be at least partially processor-implemented, with a particular processor or processors being an example of hardware. For example, at least some of the operations of a method may be performed by one or more processors or processor-implemented engines. Moreover, the one or more processors may also operate to support performance of the relevant operations in a "cloud computing" environment or as a "software as a service" (SaaS). For example, at least some of the operations may be performed by a group of computers (as examples of machines including processors), with these operations being accessible via a network (e.g., the Internet) and via one or more appropriate interfaces (e.g., an Application Program Interface (API)).

The performance of certain of the operations may be distributed among the processors, not only residing within a single machine, but deployed across a number of machines. In some example embodiments, the processors or processor-implemented engines may be located in a single geographic location (e.g., within a home environment, an office environment, or a server farm). In other example embodiments, the processors or processor-implemented engines may be distributed across a number of geographic locations.
Language Throughout this specification, plural instances may implement components, operations, or structures described as a single instance. Although individual operations of one or more methods are illustrated and described as separate operations, one or more of the individual operations may be performed concurrently, and nothing requires that the operations be performed in the order illustrated. Structures and functionality presented as separate components in example configurations may be implemented as a combined structure or component. Similarly, structures and functionality presented as a single component may be implemented as separate components. These and other variations, modifications, additions, and improvements fall within the scope of the subject matter herein.

Although an overview of the subject matter has been described with reference to specific example embodiments, various modifications and changes may be made to these embodiments without departing from the broader scope of embodiments of the present disclosure. Such embodiments of the subject matter may be referred to herein, individually or collectively, by the term "invention" merely for convenience and without intending to voluntarily limit the scope of this application to any single disclosure or concept if more than one is, in fact, disclosed.

The embodiments illustrated herein are described in sufficient detail to enable those skilled in the art to practice the teachings disclosed. Other embodiments may be used and derived therefrom, such that structural and logical substitutions and changes may be made without departing from the scope of this disclosure. The Detailed Description, therefore, is not to be taken in a limiting sense, and the scope of various embodiments is defined only by the appended claims, along with the full range of equivalents to which such claims are entitled.

It will be appreciated that an "engine," "system," "data store," and/or "database" may comprise software, hardware, firmware, and/or circuitry. In one example, one or more software programs comprising instructions capable of being executable by a processor may perform one or more of the functions of the engines, data stores, databases, or systems described herein. In another example, circuitry may perform the same or similar functions. Alternative embodiments may comprise more, less, or functionally equivalent engines, systems, data stores, or databases, and still be within the scope of present embodiments. For example, the functionality of the various systems, engines, data stores, and/or databases may be combined or divided differently.

"Open source" software is defined herein to be source code that allows distribution as source code as well as compiled form, with a well-publicized and indexed means of obtaining the source, optionally with a license that allows modifications and derived works.

The data stores described herein may be any suitable structure (e.g., an active database, a relational database, a self-referential database, a table, a matrix, an array, a flat file, a documented-oriented storage system, a non-relational No-SQL system, and the like), and may be cloud-based or otherwise.

EXAMPLES

Example 1. Search and Testing of Type-II Bacteriocins

This example describes a method of searching for type-II bacteriocins and confirmation of the identified type-II bacteriocins having microbicidal activities.

Among the earliest antimicrobial compounds first arose in prokaryotes themselves as means to defend against microbial competitors. Of these, well characterized members include class II bacteriocins, ribosomally-synthesized polypeptides produced primarily by Gram-positive bacteria. While a number of class II bacteriocins have been described, an expanding universe of bioinformatic datasets affords means by which to identify novel bacteriocin sequences from newly sequenced genomes. In the current investigation, a new search method was created to rapidly identify bacteriocin sequences with a high degree of fidelity. This multi-component method integrates the application of a relaxed bacteriocin signal peptide search term along with an amphipathic pattern search tool as a means to select for bacteriocin-like sequences. When applied, this method accurately identifies virtually all families of known class II bacteriocins. Moreover, the method retrieved a large number of sequences having structural features characteristic of ancient antimicrobial bacteriocins. Selected sequences identified by this search were synthesized and demonstrated to exert potent antimicrobial efficacy in vitro against a broad spectrum of human pathogens. These results represent discovery of new sequences and putative subclasses of type II bacteriocin may serve as physicochemical templates for innovative anti-infective therapeutic agents to meet the challenge of antibiotic resistance.

Methods and Materials

Identification of the Type IIa Bacteriocin Consensus Formula

To identify a consensus formula that was consistent with a majority of known class IIa bacteriocins, multiple sequence alignments with prototypic representatives of this family were carried out using CLUSTAL W, and further analyzed using MEGA 6. Sites of potential conservation were scored for specific residue or chemical identity to generate a 12 residue consensus formula. Several positions within the formula were degenerate depending on sequence or chemical (polar residues) conservation at individual sites.

Apply Method to Identify Putative Bacteriocins

Once this consensus formula was created, it was used with ScanProsite (**) to carry out a pattern search of the UniProtKB/Swiss-Prot and UniProtKB/TrEMBL databases. Search results were further limited as follows: 1) protein size (<80 residues); 2) bacterial organisms; and 3) localization of the pattern to the first 25 residues of the protein with a "<X(0,25)" logical operator.

Search for Amphipathic α-Helices within Retrieved Dataset

Figure 3:
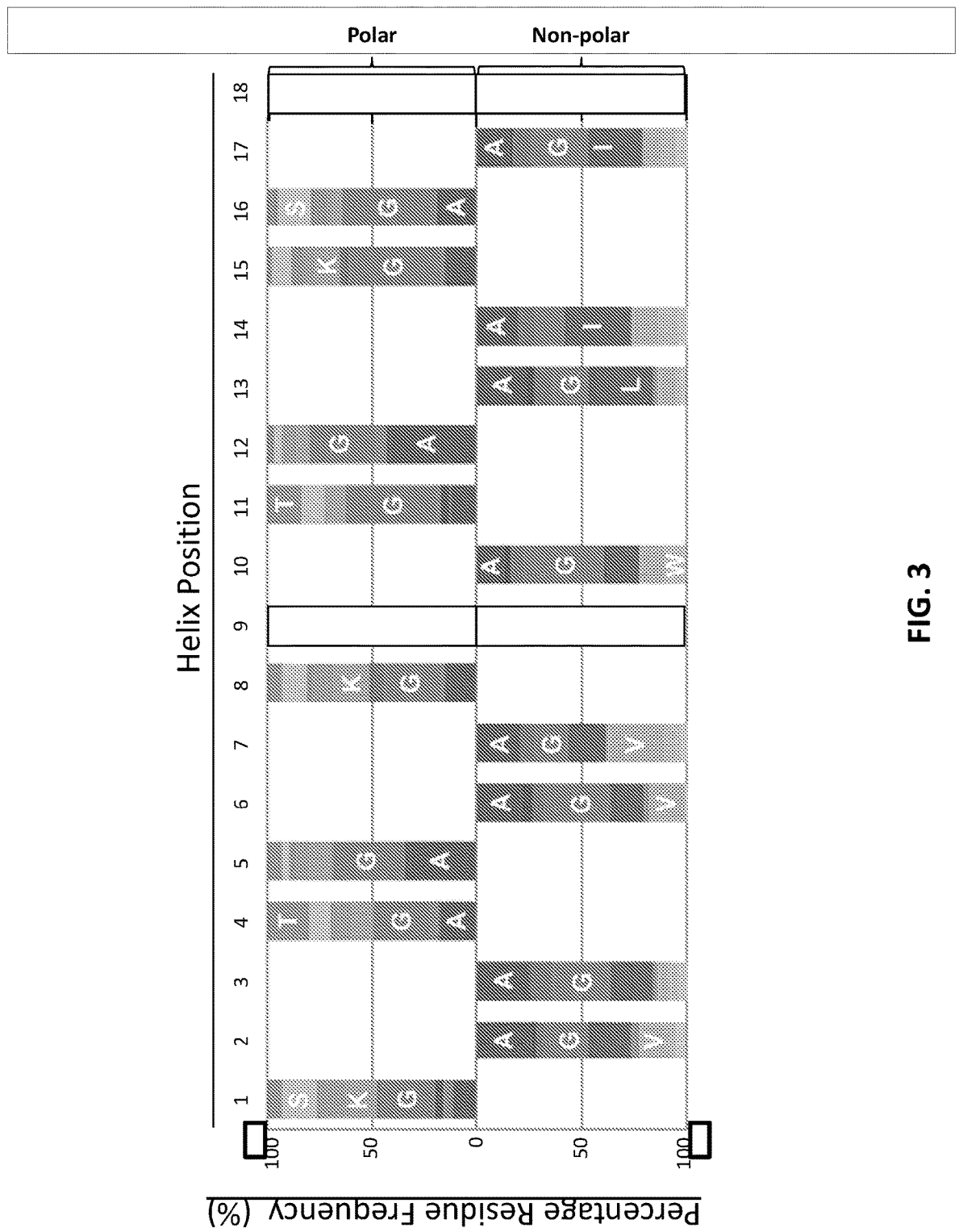
FIG. 3 shows positional and spatial amphipathic residue frequency. Percentages of individual residues on either the polar or non-polar peptide face of study peptides are represented as various color blocks. Residues above the x-axis are found on the polar face of retrieved peptides and residues below the axis are found on the non-polar face.

Results from the above database search were then formatted as per UniProtKB Swiss-Prot requirements and submitted as a sequence database against which additional pattern searches could be carried out. This database was then queried with a degenerate amphipathic sequence formula to scan for α-helical domains within retrieved protein dataset. The formula was advanced one position at a time through 18 iterations to represent an entire 18-residue helical wheel span (FIG. 3). Iteration 1 of this query sequence is listed below:

```
X-[VILMCFWYAG]-[KRHEDNQSTAG]-[KRHEDNQSTAG]-
[VILMCFWYAG]-[VILMCFWYAG]-[KRHEDNQSTAG]-
```

```
[KRHEDNQSTAG]-[VILMCFWYAG]-X[KRHEDNQSTAG]-
[VILMCFWYAG]
```

As the mature bacteriocin peptide is usually located near the C-terminus of the protein, search parameters included a "X(0,30)>" logical operator to restrict results to the final 30 residues of the protein.

Biophysical Parameter Determination

Retrieved datasets were subjected to batch analysis to compute the PI of individual sequences using ExPasy Compute PI/MW tool. Hydrophobic moment, mean hydrophobicity, net charge [K and R (+1), H (+0.5), D and E (−1)] and K and R residue frequency were determined using Python programs created for this purpose.

Operon Characterization

To probe for new, as yet unidentified, bacteriocins, the genomic regions surrounding uncharacterized hits were analyzed. A total of 20,000 base pairs (10,000 upstream and 10,000 downstream) from the identified sequence were scored for the presence of typical bacteriocin operon genes (ABC transporters, immunity proteins, pheromones) using the Ensembl Genomes REST API. Sequences that were found to be closely associated with bacteriocin-operon genes were prioritized for further study.

Peptide Synthesis

Select candidate microbicidal peptides were commercially synthesized by BioMatik at a level of >98% purity. Lyophilized peptides were reconstituted with ddIH20 and stored in aliquots at −20° C.

Assay for Antimicrobial Activity

Antimicrobial assays were performed using a well-established radial diffusion method modified to pH 5.5 or 7.5. A panel of microorganisms was tested: Gram-positive *Staphylococcus aureus* (ISP 479C, ISP 479R); Gram-negative *Salmonella typhimurium* (MS 5996s, MS 14028), *Pseudomonas aeruginosa* (PA01), *Acinetobacter baumanni* (17928) and the fungus *Candida albicans* (36082S, 36082R). Logarithmic phase organisms were inoculated ($10^6$ CFU/ml) into buffered agarose, and poured into plates. Peptides (10 μg) were introduced into wells in the seeded matrix, and incubated for 3 h at 37° C. Nutrient overlay medium was applied, and assays incubated at 37° C. or 30° C. for bacteria or fungi, respectively. After 24 h, zones of inhibition were measured. Independent experiments were repeated a minimum of two times.

Results

Identification of a Class II Bacteriocin Consensus Sequence Formula

To identify a signal peptide consensus formula that was consistent with a majority of known Class II (a-d) bacteriocins, multiple sequence alignments with prototypic representatives from these families were carried out. Initial alignments were generated using CLUSTAL W, followed by manual adjustment to align the double glycine motif using MEGA 6.

Analysis of these alignments revealed a number of conserved residues within the signal peptide domain that were used to generate a 12 residue consensus formula as follows:

```
    -12       -11     -10    -9      -8    -7 -6-5    -4    -3-2-1
   [LI]-[KREDNQSTYH]-X-[KREDNQSTYH]-X-[MLV]-X-X-[IVLT]-X-G-G
```

As several positions within these alignments were conserved only at the physicochemical level (positions −9 and −11), they are represented by degenerate search terms reflecting the likelihood of a polar residue at these positions.

Primary Screen: Signal Peptide Method

The above formula was used as a ProSite query against the UniProtKB/Swiss-Prot and /TrEMBL databases and retrieved a total of 3050 sequences. Within this dataset the following classes of bacterial proteins were represented: 376 bacteriocins; 45 putative bacteriocins; 129 competence enhancing peptides; 7 pheromones; 12 autoinducing peptides; 170 putative bacteriocin related proteins; 182 other proteins; and 2129 uncharacterized sequences. All of the sequences are provided in the appended Sequence Listing, while a number of representative sequences are shown in Table 3 below.

In general, the majority of all sequences (bacteriocins and non-bacteriocins) retrieved with the signal peptide consensus were from Gram-positive Firmicutes (64%) and other Gram-positive organisms (Actinobacteria [2%], Deinococci [>1%]). Sequences were also retrieved from a number of Gram-negative organisms (Bacteroidetes [Chlorobi group, 13%], Chlamydia [>1%], Chloracidobacterium [>1%], Cyanobacteria [3%], Dehalococcoides [>1%], Fusobacteriales [>1%], Planctomycetia [>1%], Proteobacteria [17%]).

With respect to specificity, the formula retrieved a high percentage of the known Class II bacteriocin sequences. Notably, members from nearly all of the of Class IIa and IIb families were retrieved by the search. In particular, the formula identified representatives from approximately 90% of Class IIa families and 88% of Class IIb families. By comparison, many fewer of the cyclic, (13%) Class IIc, and other, (13%) Class IId, peptide groups were retrieved (Table 1). For many of the listed bacteriocins more than one representative of each family was retrieved. In some cases a large number of family members were retrieved such as for the class IIb Lactobin family where more than 90 members were identified.

Secondary Screen: Amphipathic Helix Method

As a refinement of this search, the retrieved sequences from the primary scan were formatted as a database, and a secondary screen with the amphipathic helix formula was carried out. In this case, the search was targeted to the final 30 residues of the peptide to probe for the presence of this motif within the mature portion of the peptide. When compared with the primary screen, this secondary screen provided information regarding the likelihood that retrieved peptides were α-helical in nature.

With this refinement, the total number of retrieved sequences was 1557 representing: 302 bacteriocins; 27 putative bacteriocins; 31 competence enhancing peptides; 1 pheromone; 11 autoinducing peptides; 78 putative bacteriocin related proteins; 65 other proteins; and 1042 uncharacterized sequences. Notably, while fewer sequences were retrieved with this secondary screen, the relative percentage of known bacteriocins within the characterized protein sub-dataset was increased from 41% to 53% of the returned sequences.

When the secondary alpha helical screen was applied to the dataset, nearly all of the Class IIa and IIb bacteriocin families were retrieved, suggesting that most of these peptides may be capable of adopting an α-helical conformation in membrane mimetic environments. One notable exception to this observation was for the pediocin sequences, which were not retrieved by the amphipathic sequence formula. However, this result may be expected, as many members of the pediocin-like bacteriocin group have been shown to form a hairpin-like structure at the C-terminus.

Residue Frequency within Bacteriocins

Given that the amphipathic sequence formula retrieves aligned datasets, peptides can be scored for the abundance of individual residues along an amphipathic helical span. When these alignments are carried out, the abundance of individual residues along both the predicted polar and non-polar faces of the retrieved helices can be calculated. In these studies, such alignments indicated that glycine was the most abun-

TABLE 1

Bacteriocin Peptides Retrieved by Signal Consensus Formula Search

| Class | | Peptide | Organism |
|---|---|---|---|
| IIa | Acidocin | 8912, LF221B, M | *Lactobacillus acidophilus* |
| | Avicin | A | *Enterococcus avium* (*Streptococcus avium*) |
| | Carnobacteriocin | A, B2, BM1 | *Carnobacterium maltaromaticum* |
| | Curvacin | A | *Lactobacillus curvatus* |
| | Divergicin | 750 | *Carnobacterium divergens* (*Lactobacillus divergens*) |
| | Enterocin | B, 1071A/1B, CRL35, C2, NKR-5-3A/3Z, HF, Xbeta | *Enterococcus faecium* |
| | Leucocin | A, B, K, N, Q | *Leuconostoc gelidum*, *Leconostoc carnosum*, |
| | Mundticin | KS, L | *Enterococcus pallens* ATCC BAA-351 |
| | PapA | | *Listeria aquatica* FSL S10-1188 |
| | Piscicolin | 126 | *Carnobacterium maltaromaticum* |
| | Plantaricin | A, F, J, 1.25 beta, c81F | *Lactobacillus plantarum* |
| | Sakacin | A, D98c, P, X | *Lactobacillus sakei* |
| IIb | Amylovorin | L alpha, L beta | *Lactobacillus amylovorus* |
| | Bacteriocm | GatX, BacSJ2-8 | *Streptococcus pneumoniae* |
| | Brevicin | 925A | *Lactobacillus brevis* |
| | Gassericin | T | *Lactobacillus gasseri* |
| | Lactobin/Cerein | A/7B | *Streptococcus australis* ATCC 700641 |
| | Lactocin | 705 alpha, 705 beta | *Lactobacillus curvatus* |
| | Lactacin | F | *Lactobacillus johnsonii* |
| IId | Lactococcin | G | *Clostridium perfringens* (strain SM101/Type A) |
| | Mesentericin | B105, Y105 | *Leuconostoc mesenteroides* |
| | Weissellicin | L | *Weissella hellenica* | dant residue at nearly all positions of these putative helical spans, whether present on the hydrophobic or hydrophilic face of the helix. In the few positions where glycine was not the most abundant residue, often the next most tiny and conformationally flexible residue, alanine, was present.

On the polar face of the peptide, after glycine and alanine the next most abundant residues were the cationic residue lysine and neutral hydrophilic residues threonine and serine. Notably, the cationic residue arginine was rarely found on the polar face of these bacteriocin amphipathic spans.

On the non-polar face the most abundant residues after glycine and alanine were valine, leucine and isoleucine. Tryptophan was also found with some abundance on this face at some positions, although tyrosine and phenylalanine were infrequently found in this analysis.

Analysis of Uncharacterized Sequences

Besides retrieving a significant number of known bacteriocin sequences, the amphipathic sequence method also identified a large number (~1042) of as yet uncharacterized sequences. If bacteriocins are represented to an equivalent degree between the characterized and uncharacterized datasets, it would be predicted that more than 550 of these unknown sequences may be novel bacteriocins (53% percent unknown=552).

As a means to characterize these unknown sequences, they were initially subjected to computational (Clustal W) and manual (MEGA 6) alignment (Supplemental Figure X). Unknown sequences were also scored for the following biophysical parameters: PI, net charge (Q), hydrophobic moment (µH), hydrophobicity (H) and arginine to lysine ratio ($N_K/N_K+N_R$).

Results from the above analyses were integrated, and four sequences (Table 2) from phylogenetically distinct organisms were chosen for further characterization (peptide name; SwissProt accession; species): peptide 1—A0RKV8 (*Bacillus thuringiensis*); peptide 2—D6E338 (*Eubacterium rectale*); peptide 3—B3ZXE9 (*Bacillus cereus*); peptide 4—R2S6C2 (*Enterococcus pallens*).

TABLE 2

Four identified peptide sequences, each along with a longer version, which was synthesized and tested

| No. | Name | Organism | Sequence | SEQ ID NO: |
|---|---|---|---|---|
| A0RKV8 (Peptide 1) | Uncharacterized protein | *Bacillus thuringiensis* (strain Al Hakann) | EWGKQLGKWI GSKIK | 1 |
| Peptide 1- longer version | | | FKVIVTDAGH YPREWGKQLG KWIGSKIK | 5 |
| D6E338 (Peptide 2) | Uncharacterized protein | [*Eubacterium*] rectale DSM 17629 | KYVKNYLDFI KKAIDIFRPM PI | 2 |
| Peptide 2- longer version | | | KRNYSIEKYV KNYIDFIKKA IDIFRPMPI | 6 |
| B3ZXE9 (Peptide 3) | Uncharacterized protein | *Bacillus cereus* 03BB108 | KWAKSAGKWI ASKIK | 3 |
| Peptide 3- longer version | | | KTIATNATYY PNKWAKSAGK WIASKIK | 7 |
| R2S6C2 (Peptide 4) | Bacteriocin-type signal sequence | *Enterococcus pallens* ATCC BAA-351 | KIGKTVGTIV RKGFEIWSIF K | 4 |
| Peptide 4- longer version | | | QYDKTGYKIG KTVGTIVRKG FEIWSIFK | 8 |

| No. | Count K | Count R | Q18 | Q Full | HM18 | HM18* Qfull | PI | HM*PI | H18 | Charge | µH |
|---|---|---|---|---|---|---|---|---|---|---|---|
| A0RKV8 | 4 | 0 | 3 | 3 | 0.58 | 1.7 | 10 | 5.81 | 0.33 | +3.5 | 0.48 |
| D6E338 | 4 | 1 | 3 | 3 | 0.67 | 2.03 | 5.18 | 3.52 | 0.39 | +4 | 0.41 |
| B3ZXE9 | 5 | 0 | 5 | 5 | 0.50 | 2.51 | 9.94 | 5.00 | 0.26 | +6 | 0.35 |
| R2S6C2 | 3 | 1 | 3 | 4 | 0.58 | 2.34 | 9.46 | 5.54 | 0.43 | +4 | 0.44 |

Figure 2:
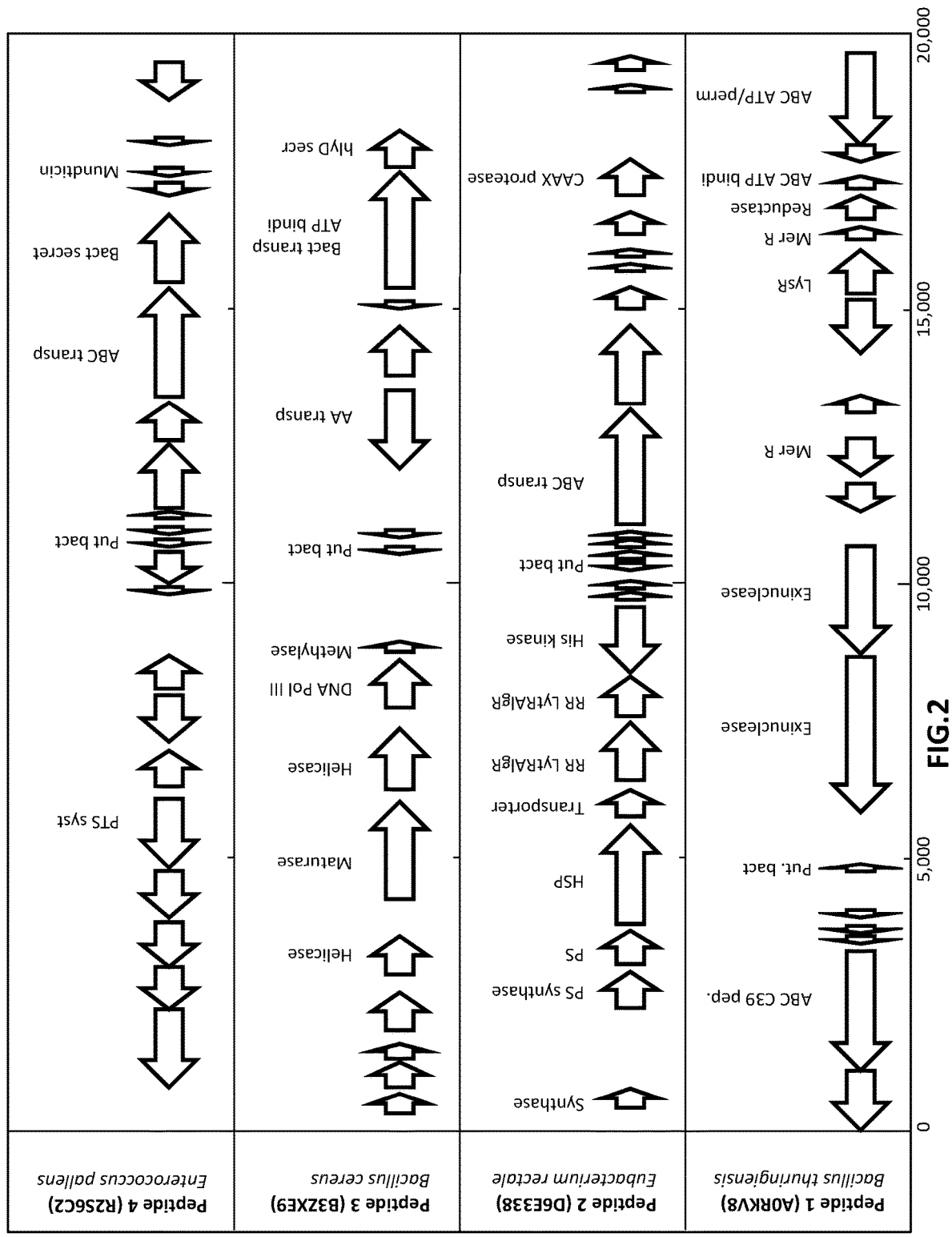
FIG. 2 shows the genomic environment surrounding putative bacteriocins. Analysis of 20 kb region surrounding putative bacteriocin genes. Red—putative bacteriocin; gray—hypothetical proteins; dark blue—C39 bacteriocin processing peptidase; medium blue—exinuclease ABC subunit; light blue—ABC transporter, ATP binding protein; green other enzyme; purple—polymerase related protein.

At the genetic level, peptides 1-4 were localized to bacteriocin-like operon regions containing ABC transporters and other bacteriocin-associated genes (FIG. 2). In particular, all were localized within 20 kb of an ABC transporter protein, as well as ABC transporter accessory genes such as C39 peptidases and ATP binding proteins. Many of the putative bacteriocins were also localized within clusters of small genes that resembled other bacteriocin sequences and/or pheromones. In some cases, prototypic bacteriocin immunity peptides were also localized within the putative bacteriocin operons.

Figure 4:
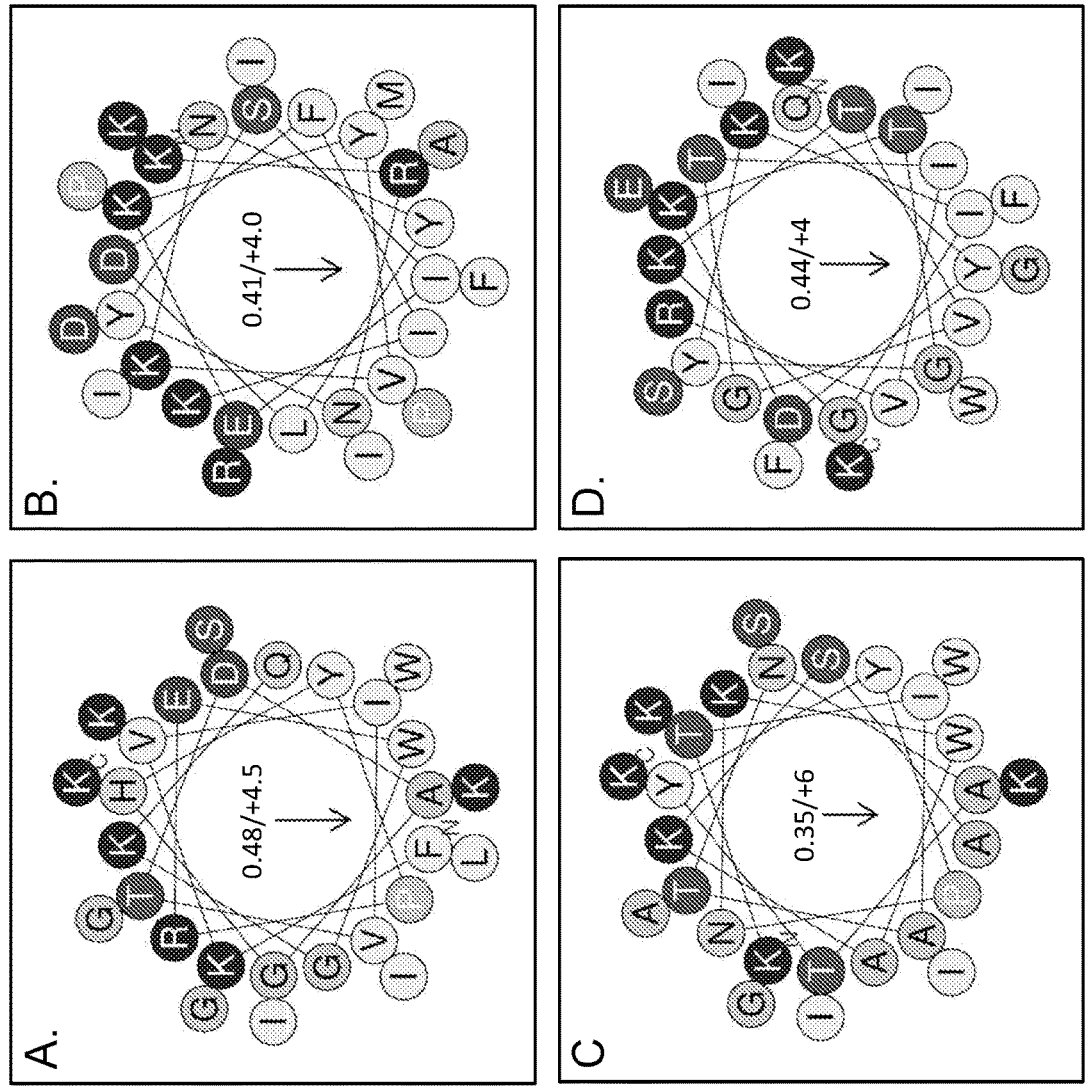
FIG. 4, with panels A-D, shows helical wheel analysis and biophysical properties of putative bacteriocins. Putative bacteriocins synthesized for assessment of antimicrobial activity. Arrows hydrophobic moment and direction. A. Peptide 1: A0RKV8 (+4.5), PI—10.7; *Bacillus thuringiensis* (G+); FKVIVTDAGHYPREWGKQLGKWIGSKIK, SEQ ID NO: 5 (28). B. Peptide 2: D6E338 (+4), PI 10.3; *Eubacterium rectale*; KRNYSIEKYVKNY1DFIKKAIDIFRPMPI, SEQ ID NO: 6 (29). C. Peptide 3: B3ZXE9 (+6), PI—10.9; *Bacillus cereus*; KTIATNATYYPNKWAKSAGKWIASKIK, SEQ ID NO: 7 (27). D. Peptide 4: R2S6C2 (+4), PI—10.5; *Enterococcus pallens*, QYDKTGYKIGKTVGTIVRKGFEIWSIFK, SEQ ID NO: 8 (28).

As a further means of characterization, peptides 1-4 were synthesized so that their microbicidal properties could be determined. This assessment revealed that all four putative bacteriocins possessed microbicidal activity against Gram positive (*S. aureus*), Gram negative (*S. typhimurium, P. aeruginosa, A. baumanni*) and fungal (*C. albicans*) organisms (FIG. 4). While active against all classes of microbes, peptides 1-4 were generally more potent towards Gram negative microorganisms than the other organisms in this study (FIG. 4).

As a test of the relative activity of these putative bacteriocins in blood versus phagolysosomal/wound septic environments, microbicidal assays were carried out in representative physiologic buffers at pH 7.5 and 5.5 respectively. In general, peptides 1-4 were typically more active at pH 7.5 than at pH 5.5, and notably peptide 3 lost nearly all of its activity against Gram positive *S. aureus* at pH 5.5.

Taken together, given their localization to bacteriocin-like operons and potent microbicidal spectrum, it seems likely that peptides 1-4 represent novel bacteriocin sequences. However, studies to isolate these putative sequences will be necessary to confirm this observation.

TABLE 3

Representative peptides identifies from the primary screen

| Accession # | Name | Comp Form Match | HM | Q | HMQ | PI | SEQ ID NO: |
|---|---|---|---|---|---|---|---|
| A1ZN33 | Uncharacterized protein | RQMVRHLRRFMRRYGRC | 0.70 | 7.5 | 5.27 | 7.93 | 9 |
| A0A0A1GSN1 | Uncharacterized protein | KNGLKKFFKWVRKL | 0.75 | 6 | 4.49 | 10.59 | 10 |
| D9SR34 | Uncharacterized protein | SLKKALKKAVSGLGKIIK | 0.66 | 6 | 3.99 | 9.6 | 11 |
| L7ZAD1 | Putative peptide pheromone/induction peptide | KTLIKFFKSLIKR | 0.72 | 5 | 3.58 | 10.36 | 12 |
| K9ESB5 | Uncharacterized protein | RCRKVYHRLWGK | 0.61 | 5.5 | 3.33 | 9.3 | 13 |
| D9SV22 | Uncharacterized protein | SLRKALKKIIDAIVK | 0.72 | 4 | 2.88 | 9.82 | 14 |
| K0NDW4 | Uncharacterized protein | SQLYKNLFKVFRK | 0.69 | 4 | 2.75 | 10.41 | 15 |
| I6WB56 | Putative plantaricin A peptide | LQMGATAIKQVKKLFKKWG | 0.55 | 5 | 2.74 | 10.48 | 16 |
| D1P3A0 | Uncharacterized protein | YKNVKAFIEKCRKVY | 0.64 | 4 | 2.54 | 9.24 | 17 |
| Q38Y68 | Putative bacteriocin inducing peptide | REYLNKITKWIKH | 0.71 | 3.5 | 2.48 | 9.92 | 18 |
| C2SB64 | Uncharacterized protein | WIGKVGKQYKKAT | 0.59 | 4 | 2.34 | 9.33 | 19 |
| R5IRG3 | Uncharacterized protein | GSIISSIVRGGILILELGRSFGSALRRLLKK | 0.45 | 5 | 2.24 | 10.01 | 20 |
| B1SE87 | Bacteriocin-type signal sequence | RQAAKAIGKAVGKLF | 0.55 | 4 | 2.22 | 9.78 | 21 |
| U2JCR9 | Bacteriocin-type signal sequence | MRNGFEIFKKIAKSIIDAFRHA | 0.62 | 3.5 | 2.16 | 8.09 | 22 |
| R2SSG8 | Bacteriocin-type signal sequence | AVGKNVWEFGKGFVKGWNKAK | 0.51 | 4 | 2.02 | 10.09 | 23 |
| R2S6C2 | Bacteriocin-type signal sequence | KTGYKIGKTVGTIVRKGFEIWS | 0.50 | 4 | 2.01 | 9.46 | 24 |
| E3R2A6 | Uncharacterized protein | GGSKGWNKFWKS | 0.64 | 3 | 1.93 | 9.52 | 25 |
| K1N8K9 | Uncharacterized protein | GGSKGWNKFWKS | 0.64 | 3 | 1.93 | 9.52 | 26 |
| D7V8H5 | Uncharacterized protein | GGGAWKNFWSSLRKGF | 0.62 | 3 | 1.86 | 9.99 | 27 |

TABLE 3-continued

Representative peptides identifies from the primary screen

| Accession # | Name | Comp Form Match | HM | Q | HMQ | PI | SEQ ID NO: |
|---|---|---|---|---|---|---|---|
| R9X316 | Uncharacterized protein | KQWYRLGERVGRVA | 0.62 | 3 | 1.85 | 9.69 | 28 |
| E7S527 | Uncharacterized protein | GSACAYMRRVCKK | 0.46 | 4 | 1.84 | 9.1 | 29 |
| E8KCS4 | Bacteriocin-type signal sequence | RRITSFFANLFQK | 0.61 | 3 | 1.84 | 9.99 | 30 |
| A4BNK7 | Uncharacterized protein | QKAMKNIRGGARG | 0.44 | 4 | 1.77 | 11.91 | 31 |
| D3H665 | Excreted peptide | VKWCNKLFGTGRHVA | 0.50 | 3.5 | 1.74 | 4.43 | 32 |
| C2CZ62 | Bacteriocin-type signal sequence | LSHISGGVTRYRHHEKKSWIDDFMKGFKK | 0.31 | 5.5 | 1.73 | 6.82 | 33 |
| I0SA65 | Uncharacterized protein | SITNFWKKYFNH | 0.69 | 2.5 | 1.72 | 5.45 | 34 |
| I0T6B7 | Uncharacterized protein | SITNFWKKYFNH | 0.69 | 2.5 | 1.72 | 5.45 | 35 |
| R6SQB3 | Uncharacterized protein | YNPFKNIFHRFSNGH | 0.57 | 3 | 1.71 | 10.82 | 36 |
| K8WE53 | Uncharacterized protein | YKNVKAFIEKCRS | 0.56 | 3 | 1.69 | 9.17 | 37 |
| G0IAI7 | Uncharacterized protein | GRFFGGIYNAGRSFGRNV | 0.56 | 3 | 1.68 | 9.22 | 38 |
| A0A0E2PPW4 | Bacteriocin-type signal sequence | GRFFGGIYNAGRSFGRNV | 0.56 | 3 | 1.68 | 9.22 | 39 |
| G6A7G8 | Uncharacterized protein | RGIIGIGKKLFG | 0.55 | 3 | 1.66 | 9.7 | 40 |
| R7KCN7 | Uncharacterized protein | GTILNQLNKLISILVDSGKSLGSSIRRIS | 0.55 | 3 | 1.65 | 8.98 | 41 |
| A0A0B5ZQ16 | Uncharacterized protein | INGGKTIATNATYYPNKWAKSVGKWIAS | 0.41 | 4 | 1.63 | 9.94 | 42 |
| G6CHH9 | Bacteriocin-type signal sequence domain protein | SNFIHKIKQIFTH | 0.54 | 3 | 1.62 | 9.82 | 43 |
| Q5FI67 | Uncharacterized protein | IGGSAKSYIRRLG | 0.54 | 3 | 1.61 | 9.69 | 44 |
| R6Y309 | Uncharacterized protein | GSLFSALAKGFNVFVDMGRALGSSIRRLVNN | 0.53 | 3 | 1.58 | 9.18 | 45 |
| C0WN46 | Bacteriocin-type signal sequence | LSHISGGVTRYRYHEKKSWIDDFMKGFKK | 0.32 | 5 | 1.58 | 6.82 | 46 |
| C0XJC5 | Bacteriocin-type signal sequence | LSHISGGVTRYRYHEKKSWIDDFMKGFKK | 0.32 | 5 | 1.58 | 6.82 | 47 |
| R5Y709 | Uncharacterized protein | AAFINGVKGIFSIFFDFGNSLGSSIRRIK | 0.52 | 3 | 1.57 | 9.9 | 48 |

TABLE 3-continued

Representative peptides identifies from the primary screen

| Accession # | Name | Comp Form Match | HM | Q | HMQ | PI | SEQ ID NO: |
|---|---|---|---|---|---|---|---|
| U2YG00 | Uncharacterized protein | RGMIGIGKKLFG | 0.51 | 3 | 1.52 | 9.63 | 49 |
| R5IWG8 | Uncharacterized protein | ATFINAIVKGLSLIIELGKSLGSSFRRIT | 0.50 | 3 | 1.51 | 9.51 | 50 |
| B3ZXE9 | Uncharacterized protein | INGGKTIATNATYYPNKWAKSAGKWIAS | 0.38 | 4 | 1.51 | 9.94 | 51 |
| B6WP3 | Bacteriocin-type signal sequence | QIYKEAKDFVNNRAGNLIRGFKDVWKN | 0.49 | 3 | 1.48 | 9.1 | 52 |
| A0A075JT42 | Uncharacterized protein | LSRVKGGMSRIAG | 0.49 | 3 | 1.46 | 9.3 | 53 |
| C2MRT0 | Uncharacterized protein | KWGKELGRWIGS | 0.73 | 2 | 1.46 | 10.09 | 54 |
| A0RKV8 | Uncharacterized protein | REWGKQLGKWIGS | 0.71 | 2 | 1.41 | 10 | 55 |
| G2G092 | Bacteriocin-type signal sequence domain protein | SGGGKFIGNLIKLARP | 0.44 | 3 | 1.33 | 10.49 | 56 |
| F9D2A0 | Uncharacterized protein | LRFLDRIMGGFRQ | 0.66 | 2 | 1.32 | 11.55 | 57 |
| A0A059KSD2 | Uncharacterized protein | FGGLLRHLFGFK | 0.52 | 2.5 | 1.31 | 9.9 | 58 |
| S3ZDV9 | Uncharacterized protein | LPNLGRRMVGAW | 0.65 | 2 | 1.31 | 10.55 | 59 |
| F7QWM3 | Uncharacterized protein | LSHVNGGYNRLAGRIGHYT | 0.44 | 3 | 1.31 | 9.52 | 60 |
| W9BZA4 | Unchamcterized protein | IGGLLGGIFGLLRK | 0.65 | 2 | 1.30 | 9.13 | 61 |
| A0A0E4FN40 | Uncharacterized protein | RNGARIAGRLVGIA | 0.43 | 3 | 1.29 | 5.11 | 62 |
| G8UJ51 | Uncharacterized protein | RNGARIAGRLVGIA | 0.43 | 3 | 1.29 | 5.11 | 63 |
| R4LKG1 | Unchamcterized protein | ANHANGLFRRVL | 0.51 | 2.5 | 1.27 | 5.56 | 64 |
| A9EDI1 | Uncharacterized protein | FSKLQKLIGGVEK | 0.63 | 2 | 1.25 | 9.73 | 65 |
| D5BXP3 | Uncharacterized protein | AARRAFASGRKA | 0.31 | 4 | 1.25 | 10.83 | 66 |
| A0A081QIR4 | Uncharacterized protein | GIAGVLNAAVQIFNAGYKFGSDFARRGR | 0.41 | 3 | 1.24 | 4.99 | 67 |
| A0A0F3HMJ4 | Uncharacterized protein | GIAGVLNAAVQIFNAGYKFGSDFARRGR | 0.41 | 3 | 1.24 | 4.99 | 68 |
| G0IAJ8 | Uncharacterized protein | GIAGVLNAAVQIFNAGYKFGSDFARRGR | 0.41 | 3 | 1.24 | 4.99 | 69 |
| A0A086B184 | Uncharacterized protein | GKSCWKILKDLIGL | 0.62 | 2 | 1.24 | 9.6 | 70 |
| A0A0F2CT49 | Uncharacterized protein | GIAGVLNAAVQIFNAGYKFGSDLARRGR | 0.41 | 3 | 1.24 | 4.99 | 71 |

TABLE 3-continued

Representative peptides identifies from the primary screen

| Accession # | Name | Comp Form Match | HM | Q | HMQ | PI | SEQ ID NO: |
|---|---|---|---|---|---|---|---|
| A8SCT0 | Uncharacterized protein | IGKVFNYIARIFSGASSIIN | 0.62 | 2 | 1.23 | 4.94 | 72 |
| D4K7U6 | Uncharacterized protein | IGKVFNYIARIFSGASSIIN | 0.62 | 2 | 1.23 | 4.94 | 73 |
| Q040A1 | Uncharacterized protein | VAKDAWNHLDQIRSGWRKAGNS | 0.48 | 2.5 | 1.20 | 9.3 | 74 |
| A0A0A2CDF7 | Uncharacterized protein | KTYKKVAKKIEDYVDNGP | 0.58 | 2 | 1.16 | 4.81 | 75 |
| F8HC99 | Uncharacterized protein | FSSGYKFGTDLARRGR | 0.38 | 3 | 1.15 | 9.6 | 76 |
| F8LGE1 | Uncharacterized protein | FSSGYKFGTDLARRGR | 0.38 | 3 | 1.15 | 9.87 | 77 |
| T0TBH8 | Uncharacterized protein | TTLLTGVFGWLKKF | 0.57 | 2 | 1.13 | 6.54 | 78 |
| C7H4R6 | Uncharamcterized protein | VGKLFNYIARVFSAGSSIVN | 0.54 | 2 | 1.09 | 4.66 | 79 |
| F8N9W8 | Uncharacterized protein | IDSFKKGADKANR | 0.54 | 2 | 1.09 | 4.83 | 80 |
| A0A077E9X6 | Uncharamcterized protein | KKGLRQITGGME | 0.54 | 2 | 1.09 | 8.84 | 81 |
| E2ZM85 | Uncharacterized protein | NVGKVFNAIARIFSGASS | 0.54 | 2 | 1.07 | 4.99 | 82 |
| R4KBP7 | Uncharacterized protein | VKNLFNQISVQQKTAQEFQQMMNKFPQ | 0.53 | 2 | 1.06 | 6.12 | 83 |
| U2J1M1 | Uncharacterized protein | GGNWINVFKSVVDIARRG | 0.52 | 2 | 1.05 | 9.4 | 84 |
| A0A0G0A6F6 | Uncharacterized protein | TSLESLGSRARRVLKEIS | 0.52 | 2 | 1.05 | 9.81 | 85 |
| R7F343 | Uncharacterized protein | GSLLNAFVDILKVLLDAGRSVGSGIRRAT | 0.52 | 2 | 1.04 | 9.1 | 86 |
| Q8RTK6 | Uncharacterized protein | KTLATVIGGGKGGGILSWFIGESSDIWKGFKKGMNHYNK | 0.23 | 4.5 | 1.03 | 9.7 | 87 |
| U2XMS3 | Uncharacterized protein | KTLATVIGGGKGGGILSWFIGESSDIWKGFKKGMNHYNK | 0.23 | 4.5 | 1.03 | 9.7 | 88 |
| R5MS15 | Uncharacterized protein | GSILNSFIRYVNVFFEIGQAFGSAIRR | 0.51 | 2 | 1.02 | 9.92 | 89 |
| D2JC35 | Uncharacterized protein | GBKIGKLLREVREAK | 0.51 | 2 | 1.02 | 9.22 | 90 |
| F7QWF6 | Uncharacterized protein | IVQGAVAVFKSGYRH | 0.41 | 2.5 | 1.02 | 9.9 | 91 |
| H3NC25 | Uncharacterized protein | TVGGSYSSACKRVWNAK | 0.34 | 3 | 1.01 | 10.12 | 92 |
| R5MUU1 | Uncharacterized protein | ATFFNALARSLSTISDIGRSLGTAIR | 0.50 | 2 | 1.01 | 10.44 | 93 |
| R6GW12 | Uncharacterized protein | TQMINSFVKLVSTLLDLGRTMGSALR | 0.50 | 2 | 0.99 | 10.01 | 94 |
| R6C487 | Uncharacterized protein | SVGTIINAVVKAISLLNELGQQLGSAIRR | 0.48 | 2 | 0.95 | 9.74 | 95 |

TABLE 3-continued

Representative peptides identifies from the primary screen

| Accession # | Name | Comp Form Match | HM | Q | HMQ | PI | SEQ ID NO: |
|---|---|---|---|---|---|---|---|
| A0A0F4NQ60 | Uncharacterized protein | SGPAWLSRYLHK | 0.38 | 2.5 | 0.95 | 5.28 | 96 |
| Q5FI70 | Uncharacterized protein | VGRGLWENLSNIFKH | 0.62 | 1.5 | 0.93 | 10.35 | 97 |
| X5CZ49 | Putative inducing factor protein | THLLAGLWDWFKR | 0.60 | 1.5 | 0.91 | 5.38 | 98 |
| R9JDF1 | Uncharacterized protein | SSVKQFFEKGARSA | 0.45 | 2 | 0.89 | 6.7 | 99 |
| E1TJ04 | Uncharacterized protein | AAHRAIAKVAAT | 0.36 | 2.5 | 0.89 | 10.89 | 100 |
| A7GJQ0 | Uncharacterized protein | TGFYNGYRNAGR | 0.44 | 2 | 0.88 | 5.5 | 101 |
| A0A5I2E5 | Uncharacterized protein | SGPAWLNRYLNK | 0.44 | 2 | 0.88 | 4.73 | 102 |
| A0A0H2MUQ5 | Uncharacterized protein | SGPAWLNRYLNK | 0.44 | 2 | 0.88 | 4.71 | 103 |
| F9T9J1 | Uncharacterized protein | SGPAWLNRYLNK | 0.44 | 2 | 0.88 | 4.71 | 104 |
| R6FA54 | Uncharacterized protein | KVKQFFEKGARSAME | 0.44 | 2 | 0.88 | 6.55 | 105 |
| R6W634 | Uncharacterized protein | KVKQFFEKGARSAME | 0.44 | 2 | 0.88 | 6.05 | 106 |
| R2P4R2 | Bacteriocin-type signal sequence | NNLSKGGAKCGAAIAGGL | 0.44 | 2 | 0.87 | 9.39 | 107 |
| A0A086B186 | Uncharacterized protein | KEILTHVKGGAAGSGYINTVSGECNSSGRSCWKALKDLLG | 0.34 | 2.5 | 0.86 | 9.7 | 108 |
| U2IOQ7 | Uncharacterized protein | QGGGVIGRLLIKAAANA | 0.43 | 2 | 0.86 | 5.1 | 109 |
| A0A0D6XRS2 | Uncharacterized protein | GWAGRIAGKVAGGVRSLADG | 0.43 | 2 | 0.86 | 5.13 | 110 |
| R9N5C7 | Uncharamcterized protein | TQVKQFFEKGAKSA | 0.43 | 2 | 0.85 | 7.89 | 111 |
| U2QX19 | Uncharacterized protein | QQLVTLIRGGCAKIIA | 0.42 | 2 | 0.85 | 10.56 | 112 |
| G6F0H8 | Uncharacterized protein | ANIIRTGLKNGDNWATIGKNIG | 0.42 | 2 | 0.85 | 10.29 | 113 |
| R7IG68 | Uncharacterized protein | LDSINGGGKKLWYLLGAGLSFFLGLFSGLVNPVKC | 0.42 | 2 | 0.84 | 7.9 | 114 |
| R6SN80 | Uncharacterized protein | MKTCKGCGASILST | 0.42 | 2 | 0.84 | 8.75 | 115 |
| C9QIT0 | Uncharamcterized protein | NGPAWLNRYLTK | 0.41 | 2 | 0.83 | 4.9 | 116 |
| A3HWV0 | Putative bacteriocin-type signal sequence | VSTARKLGRDFGDFLAYCAVVSIFIADAAKDAIKTFTKL | 0.41 | 2 | 0.83 | 7.87 | 117 |
| A0A0J1CUK6 | Uncharacterized protein | QALRSYAKPAGS | 0.41 | 2 | 0.81 | 10.67 | 118 |

TABLE 3-continued

Representative peptides identifies from the primary screen

| Accession # | Name | Comp Form Match | HM | Q | HMQ | PI | SEQ ID NO: |
|---|---|---|---|---|---|---|---|
| E7S5Z5 | Uncharacterized protein | LKSIKGGGDTVFDKVNHFF | 0.53 | 1.5 | 0.80 | 9.14 | 119 |
| A0A075SGV6 | Bacteriocin-type signal sequence | LKSIKGGGDTVFDKVNHFF | 0.53 | 1.5 | 0.80 | 9.44 | 120 |
| A0A0A2YHL6 | Uncharacterized protein | SISSGLTAGYSLVRR | 0.38 | 2 | 0.77 | 4.6 | 121 |
| U1I9V8 | Uncharacterized protein | SISSGLTAGYSLVRR | 0.38 | 2 | 0.77 | 4.6 | 122 |
| X8JLI8 | Bacteriocin-type signal sequence | VINEFVKGFRQAW | 0.75 | 1 | 0.75 | 5.05 | 123 |
| A0A074JK52 | Signal peptide protein | VINEFVKGFRQAW | 0.75 | 1 | 0.75 | 5.05 | 124 |
| E457K8 | Uncharacterized protein | LGKLYKWITNVIDNIF | 0.74 | 1 | 0.74 | 7.79 | 125 |
| G2SRZ9 | Putative bacteriocin | SVNRWGAAVGTGGKA | 0.37 | 2 | 0.74 | 9.59 | 126 |
| A0A077KSQ4 | Uncharacterized protein | KGGNKAITPVREG | 0.37 | 2 | 0.74 | 9.78 | 127 |
| A0A0C1TV13 | Uncharacterized protein | IYDGVKAAVNKLAHT | 0.49 | 1.5 | 0.74 | 6.03 | 128 |
| A0A073BCT9 | Uncharacterized protein | QRVHAACNELLRGQ | 0.48 | 1.5 | 0.72 | 7.73 | 129 |
| U2PR16 | Uncharacterized protein | GDSYLQKLTGIRRHRLRALFGGGEE | 0.29 | 2.5 | 0.72 | 6.53 | 130 |
| E3CPS1 | Bacteriocin-type signal sequence | VINEFVKGFHHAW | 0.70 | 1 | 0.70 | 5.43 | 131 |
| E8KT23 | Bacteriocin-type signal sequence | VINEFVKGFHHAW | 0.70 | 1 | 0.70 | 5.43 | 132 |
| I7KH06 | Uncharacterized protein | AGYTIGKDIAKR | 0.35 | 2 | 0.69 | 4.51 | 133 |
| A0A015XA39 | Uncharacterized protein | YNKMEKILEKLS | 0.69 | 1 | 0.69 | 4.77 | 134 |
| A0A015YJT2 | Uncharacterized protein | YNKMEKILEKLS | 0.69 | 1 | 0.69 | 4.77 | 135 |
| A0A015Z6Y8 | Uncharacterized protein | YNKMEKILEKLS | 0.69 | 1 | 0.69 | 4.77 | 136 |
| A0A016GFI9 | Uncharacterized protein | YNKMEKILEKLS | 0.69 | 1 | 0.69 | 4.77 | 137 |
| A0A017PDT5 | Uncharacterized protein | YNKMEKILEKLS | 0.69 | 1 | 0.69 | 4.77 | 138 |
| A0A0E2B796 | Uncharacterized protein | YNKMEKILEKLS | 0.69 | 1 | 0.69 | 4.77 | 139 |
| K1G3D7 | Uncharacterized protein | YNKMEKILEKLS | 0.69 | 1 | 0.69 | 4.49 | 140 |

TABLE 3-continued

Representative peptides identifies from the primary screen

| Accession # | Name | Comp Form Match | HM | Q | HMQ | PI | SEQ ID NO: |
|---|---|---|---|---|---|---|---|
| K1G6C4 | Uncharacterized protein | YNKMEKILEKLS | 0.69 | 1 | 0.69 | 4.49 | 141 |
| D6E338 | Uncharacterized protein | SIEKYVKNYLDFIKKAID | 0.69 | 1 | 0.69 | 5.18 | 142 |
| F4KYL7 | Uncharacterized protein | HKVADTYNAIAKT | 0.46 | 1.5 | 0.69 | 4.78 | 143 |
| U2DX84 | Bacteriocin-type signal sequence | GGNIFKSIWNWIKE | 0.67 | 1 | 0.67 | 8.23 | 144 |
| A0RKV6 | Uncharacterized protein | VIGIIAGGAAIIDYGNDFVKGAKKGAK | 0.34 | 2 | 0.67 | 9.4 | 145 |
| K9EK75 | Uncharacterized protein | ARGAKEAVDRIRI | 0.34 | 2 | 0.67 | 7.63 | 146 |
| A0A0D5BK00 | Uncharacterized protein | APGGCRSIAGAGPK | 0.33 | 2 | 0.67 | 8.83 | 147 |
| T0Q2K8 | Uncharacterized protein | APGGCRSIAGAGPK | 0.33 | 2 | 0.67 | 8.59 | 148 |
| T0V1T0 | Uncharacterized protein | SWANYLSRYLKE | 0.67 | 1 | 0.67 | 7.98 | 149 |
| G2JCE9 | Bacteriocin-type signal sequence | LGKAYKWIANLIESIF | 0.67 | 1 | 0.67 | 7.95 | 150 |
| A0A077EH26 | Uncharacterized protein | APGGCRSLAGAGPK | 0.33 | 2 | 0.66 | 8.59 | 151 |
| A0A098G366 | Uncharacterized protein | SGGNRVHEGFDRMR | 0.44 | 1.5 | 0.66 | 11.57 | 152 |
| S9P0Z7 | Uncharacterized protein | GGGRGRGRDGRGRGGRGRGGRGRGGY | 0.09 | 7 | 0.66 | 6.18 | 153 |
| D4BZB4 | Uncharacterized protein | NRLVQVVGGWLHSFAL | 0.43 | 1.5 | 0.65 | 9.3 | 154 |
| D4BZB5 | Uncharacterized protein | NRLVQVVGGWLHSFAL | 0.43 | 1.5 | 0.65 | 6.69 | 155 |
| A0A0A2CWR1 | Uncharacterized protein | YKKVANYLREID | 0.65 | 1 | 0.65 | 4.29 | 156 |
| B4U1M3 | Uncharacterized protein | KVVKWVAGFFE | 0.65 | 1 | 0.65 | 5.99 | 157 |
| A0A0D1BIJ1 | Contig000026, whole genome shotgun sequence | KVVKWVAGFFE | 0.65 | 1 | 0.65 | 5.99 | 158 |
| A0A0D0Z7R1 | Contig000027, whole genome shotgun sequence | KVVKWVAGFFE | 0.65 | 1 | 0.65 | 5.99 | 159 |
| A0A0D1AR79 | Contig000095, whole genome shotgun sequence | KVVKWVAGFFE | 0.65 | 1 | 0.65 | 5.99 | 160 |
| C0MDI1 | Putative competence stimulating peptide | KVVKWVAGFFE | 0.65 | 1 | 0.65 | 5.99 | 161 |

TABLE 3-continued

Representative peptides identifies from the primary screen

| Accession # | Name | Comp Form Match | HM | Q | HMQ | PI | SEQ ID NO: |
|---|---|---|---|---|---|---|---|
| A0A0G2Z858 | Uncharacterized protein | GGGWIDGIKKIINL | 0.62 | 1 | 0.62 | 4.94 | 162 |
| L0G0E1 | Uncharacterized protein | AGIGAALFSSLIVTGGGMMSVGYSCGNKVKNGLRDY | 0.31 | 2 | 0.61 | 9.14 | 163 |
| A0A0B8T3S9 | Uncharacterized protein | GYEVGKSAAERARR | 0.30 | 2 | 0.61 | 5.23 | 164 |
| D5T3D9 | Uncharacterized protein | GGDVVKTLTRLFNQ | 0.60 | 1 | 0.60 | 4.86 | 165 |
| A0A0H3J316 | Uncharacterized protein | GGGIYDKINKFLSN | 0.58 | 1 | 0.58 | 4.19 | 166 |
| J3CI08 | Uncharacterized protein | LRTVIGGLEDCINPATGCRKI | 0.57 | 1 | 0.57 | 9.56 | 167 |
| C1CCS2 | Conserved domain protein | AALGCAAGGVKYGKILGPWGAAIGGIGGAV | 0.29 | 2 | 0.57 | 5.89 | 168 |
| F8N6B2 | Uncharacterized protein | LGRGLGCGRGCGC | 0.29 | 2 | 0.57 | 4.6 | 169 |
| Q729Z0 | Uncharacterized protein | GGVLRRCWRDWLDSFFAVQ | 0.57 | 1 | 0.57 | 11.25 | 170 |
| G6J8U1 | Putative membrane protein | AALGCAAGGVKYGRLLGPWGAAIGGIGGAV | 0.28 | 2 | 0.57 | 5.89 | 171 |
| C2EJ80 | Bacteriocin-type signal sequence | NFGKSYIGKCSF | 0.28 | 2 | 0.56 | 9.7 | 172 |
| A0A062WNU4 | Uncharacterized protein | GYIGGGNHLCKG | 0.37 | 1.5 | 0.56 | 5.08 | 173 |
| A0A064BZ31 | Uncharacterized protein | GYIGGGNHLCKG | 0.37 | 1.5 | 0.56 | 5.5 | 174 |
| A0A081QCP4 | Uncharacterized protein | GYIGGGNHLCKG | 0.37 | 1.5 | 0.56 | 5.48 | 175 |
| A0A0B7LYG0 | Uncharacterized protein | GYIGGGNHLCKG | 0.37 | 1.5 | 0.56 | 5.5 | 176 |
| A0A0E9GYM9 | Uncharacterized protein | GYIGGGNHLCKG | 0.37 | 1.5 | 0.56 | 5.11 | 177 |
| A5LKF7 | Uncharacterized protein | GYIGGGNHLCKG | 0.37 | 1.5 | 0.56 | 5.5 | 178 |
| A5M755 | Uncharacterized protein | GYIGGGNHLCKG | 0.37 | 1.5 | 0.56 | 5.5 | 179 |
| C1C6Q6 | Uncharacterized protein | GYIGGGNHLCKG | 0.37 | 1.5 | 0.56 | 5.5 | 180 |
| C1CDS2 | Uncharacterized protein | GYIGGGNHLCKG | 0.37 | 1.5 | 0.56 | 5.5 | 181 |
| D6ZLM5 | Uncharacterized protein | GYIGGGNHLCKG | 0.37 | 1.5 | 0.56 | 5.5 | 182 |
| E0Q149 | Uncharacterized protein | GYIGGGNHLCKG | 0.37 | 1.5 | 0.56 | 5.48 | 183 |
| G6LM33 | Uncharacterized protein | GYIGGGNHLCKG | 0.37 | 1.5 | 0.56 | 5.5 | 184 |

TABLE 3-continued

Representative peptides identifies from the primary screen

| Accession # | Name | Comp Form Match | HM | Q | HMQ | PI | SEQ ID NO: |
|---|---|---|---|---|---|---|---|
| M5K5U3 | Unchamcterized protein | GYIGGGNHLCKG | 0.37 | 1.5 | 0.56 | 5.5 | 185 |
| M5K8K8 | Unchamcterized protein | GYIGGGNHLCKG | 0.37 | 1.5 | 0.56 | 5.5 | 186 |
| M5N786 | Uncharacterized protein | GYIGGGNHLCKG | 0.37 | 1.5 | 0.56 | 5.5 | 187 |
| Q8CYW4 | Uncharacterized protein | GYIGGGNHLCKG | 0.37 | 1.5 | 0.56 | 5.5 | 188 |
| S9RF90 | Uncharacterized protein | GYIGGGNHLCKG | 0.37 | 1.5 | 0.56 | 7.79 | 189 |
| V8IBA1 | Uncharacterized protein | GYIGGGNHLCKG | 0.37 | 1.5 | 0.56 | 5.48 | 190 |
| V8ID01 | Uncharacterized protein | GYIGGGNHLCKG | 0.37 | 1.5 | 0.56 | 5.48 | 191 |
| A0A0F7HB86 | Uncharacterized protein | GTSAVTVCRRVATC | 0.28 | 2 | 0.56 | 8.86 | 192 |
| U2NQ09 | Uncharacterized protein | GTSAVTVCRRVATC | 0.28 | 2 | 0.56 | 8.86 | 193 |
| B9DTX9 | Putative bacteriocin | GGLGGLQTGIKYCKV | 0.27 | 2 | 0.55 | 9.1 | 194 |
| A0A0D0Z195 | Contig000004, whole genome shotgun sequence | GAIGCASRGVKLGSRIGPWGAVIGGVGSAA | 0.18 | 3 | 0.54 | 7.71 | 195 |
| A0A0D1AE73 | Contig000013, whole genome shotgun sequence | GAIGCASRGVKLGSRIGPWGAVIGGVGSAA | 0.18 | 3 | 0.54 | 7.71 | 196 |
| A0A0D0ZZF1 | Contig000024, whole genome shotgun sequence | GAIGCASRGVKLGSRIGPWGAVIGGVGSAA | 0.18 | 3 | 0.54 | 7.71 | 197 |
| C0MH64 | Putative bacteriocin | GAIGCASRGVKLGSRIGPWGAVIGGVGSAA | 0.18 | 3 | 0.54 | 7.71 | 198 |
| C0CJI1 | Uncharacterized protein | MEKVSGGASRYQH | 0.36 | 1.5 | 0.54 | 9.99 | 199 |
| R5C531 | Uncharacterized protein | MEKVSGGASRYQH | 0.36 | 1.5 | 0.54 | 9.99 | 200 |
| R6VS52 | Uncharacterized protein | IDGYCSKCAEKIRNGQ | 0.54 | 1 | 0.54 | 8.37 | 201 |
| C1C5R3 | Conserved domain protein | AALGCAAGGVKYGRLLGLMGAAIGGIGGAV | 0.27 | 2 | 0.54 | 5.89 | 202 |
| A0A085HBT8 | Uncharacterized protein | TTLSQFFSKLFG | 0.54 | 1 | 0.54 | 4.39 | 203 |
| C5RBL9 | Uncharacterized protein | VKSLLGLLGGIMGM | 0.53 | 1 | 0.53 | 9.99 | 204 |
| M1WT49 | Uncharacterized protein | EILKGGKTLVTPL | 0.53 | 1 | 0.53 | 9.96 | 205 |
| W0BBY2 | Uncharacterized protein | LSKVSGGASQMTH | 0.35 | 1.5 | 0.52 | 4.45 | 206 |
| Q5FI68 | Uncharacterized protein | GSGRGGGAQMRAIGS | 0.26 | 2 | 0.52 | 11.62 | 207 |

TABLE 3-continued

Representative peptides identifies from the primary screen

| Accession # | Name | Comp Form Match | HM | Q | HMQ | PI | SEQ ID NO: |
|---|---|---|---|---|---|---|---|
| R6R6T2 | Uncharacterized protein | TLFNYIARVFSAGSSIINN | 0.52 | 1 | 0.52 | 5.14 | 208 |
| A0A0H2UPL5 | Uncharacterized protein | SGYIGGGNHLCKG | 0.35 | 1.5 | 0.52 | 5.5 | 209 |
| K9RTP0 | Uncharacterized protein | QLTGGFRSYGRQLDG | 0.52 | 1 | 0.52 | 4.61 | 210 |
| R2M4F0 | Uncharacterized protein | TAKQCLQAIGSWG | 0.52 | 1 | 0.52 | 5.98 | 211 |
| R7ICH1 | Uncharacterized protein | ASFFNSVARILRTAYDIG | 0.52 | 1 | 0.52 | 9.85 | 212 |
| R7HKI2 | Uncharacterized protein | SMLTAIYKTLEVIYQIGESLGNYIRR | 0.51 | 1 | 0.51 | 6.15 | 213 |
| Q38Y63 | Hypothetical small peptide | GLGKLVRAGVDIG | 0.51 | 1 | 0.51 | 9.99 | 214 |
| Q6KCF2 | Putative beta-peptide | GLGKLVRAGVDIG | 0.51 | 1 | 0.51 | 9.99 | 215 |
| W4QHA2 | Uncharacterized protein | LLGLCTGFYGVYKTV | 0.50 | 1 | 0.50 | 9.65 | 216 |
| H2AM33 | Uncharacterized protein | AGLGNGLKQWNT | 0.49 | 1 | 0.49 | 6.53 | 217 |
| H1WT90 | Uncharacterized protein | VVSFGKGIVSAFG | 0.49 | 1 | 0.49 | 9.87 | 218 |
| R6N077 | Uncharacterized protein | ATMMNAIYKTIEIIFNIGEAFGSYIRR | 0.49 | 1 | 0.49 | 6.15 | 219 |
| A0A086AYC6 | Uncharacterized protein | GECRKYGRGCAEQ | 0.48 | 1 | 0.48 | 9.3 | 220 |
| R7M280 | Uncharacterized protein | MINALTKAVTALYDLGKGFGSA | 0.48 | 1 | 0.48 | 8.98 | 221 |
| R5HCU1 | Uncharacterized protein | ASFLNAISRGIETFLNLGRM | 0.48 | 1 | 0.48 | 9.78 | 222 |
| F4AF25 | Uncharacterized protein | VLSAASGAGTGIKACKSFG | 0.24 | 2 | 0.48 | 9.14 | 223 |
| W4QQL4 | Uncharacterized protein | LFGLATGFYGVYRAI | 0.48 | 1 | 0.48 | 9.87 | 224 |
| I9T9Y4 | Uncharacterized protein | YEKINGVLTRVFTFS | 0.47 | 1 | 0.47 | 7.9 | 225 |
| A0A0F3H1F2 | Unchamcterized protein | ATVNTVVNGWMRYG | 0.47 | 1 | 0.47 | 9.18 | 226 |
| T0TP63 | Uncharacterized protein | ATVNTVVNGWMRYG | 0.47 | 1 | 0.47 | 9.18 | 227 |
| E3CS41 | Uncharacterized protein | ATVNTVVNGMKYG | 0.47 | 1 | 0.47 | 9.14 | 228 |
| J8IIA4 | Uncharacterized protein | RIVTALSAFFTSGFTVL | 0.47 | 1 | 0.47 | 9.63 | 229 |
| A0A0F2DG91 | Uncharacterized protein | MGQGALNSYRDAWK | 0.46 | 1 | 0.46 | 4.61 | 230 |
| E1LEJ5 | Uncharacterized protein | MGQGALNSYRDAWK | 0.46 | 1 | 0.46 | 4.61 | 231 |

TABLE 3-continued

Representative peptides identifies from the primary screen

| Accession # | Name | Comp Form Match | HM | Q | HMQ | PI | SEQ ID NO: |
|---|---|---|---|---|---|---|---|
| C0BVX0 | Uncharacterized protein | EVKKLFQDAANSAMK | 0.46 | 1 | 0.46 | 6.03 | 232 |
| T1ZF04 | Uncharacterized protein | AKSGIAGGAGNGLRLG | 0.23 | 2 | 0.46 | 8.77 | 233 |
| L0KBX6 | Uncharacterized protein | KAMVKDGWKLIETA | 0.46 | 1 | 0.46 | 4.07 | 234 |
| A0A0D5BQU9 | Uncharacterized protein | GKLRAWGGGCDS | 0.45 | 1 | 0.45 | 9.34 | 235 |
| F9HJW5 | Uncharacterized protein | WGVFKSVIGTFGP | 0.45 | 1 | 0.45 | 4.96 | 236 |
| A0A086AWR6 | Uncharacterized protein | CANGVCRPIAGAG | 0.45 | 1 | 0.45 | 8.86 | 237 |
| Q8FUD5 | Uncharacterized protein | GGGGIARELATMLRP | 0.44 | 1 | 0.44 | 11.6 | 238 |
| I0GCL8 | Uncharacterized protein | HDGLKVAEAIIKAITH | 0.44 | 1 | 0.44 | 5.13 | 239 |
| C2LRN7 | Unchamcterized protein | NGGGILSSVAGLVKDTWGTLYSTGRDFGRSVVN | 0.43 | 1 | 0.43 | 4.44 | 240 |
| E0S535 | Uncharacterized protein | KYYTAICATYQAALDLCARVG | 0.42 | 1 | 0.42 | 6.08 | 241 |
| A0A077EAB3 | Uncharacterized protein | MAQLKGGIKSVEG | 0.42 | 1 | 0.42 | 9.05 | 242 |
| R7P6R1 | Uncharacterized protein | IIGAISGYINPVKC | 0.41 | 1 | 0.41 | 9.04 | 243 |
| K2DVP9 | Uncharacterized protein | KTADQVAREAGAGREIK | 0.41 | 1 | 0.41 | 9.05 | 244 |
| A0A0F2E6T0 | Excreted peptide | STICTRMTGYGNGII | 0.41 | 1 | 0.41 | 3.62 | 245 |
| S9SM70 | Excreted peptide | STICTRMTGYGNGII | 0.41 | 1 | 0.41 | 3.62 | 246 |
| A0A023BZ22 | Uncharacterized protein | VLAAIGGLYKAGEAIGKG | 0.41 | 1 | 0.41 | 5.05 | 247 |
| A0A077ECN9 | Uncharacterized protein | MAQLKGGMQEIAKTCAAGS | 0.40 | 1 | 0.40 | 9.07 | 248 |
| A0A077EE44 | Uncharacterized protein | MAQLKGGMQEIAKTCAAGS | 0.40 | 1 | 0.40 | 9.07 | 249 |
| U2CMK8 | Uncharacterized protein | KVKQFFEQGAKSAME | 0.40 | 1 | 0.40 | 6.04 | 250 |
| F8LL37 | Uncharacterized conserved protein | VATGVGNGLRLGIKTRTWQGAVAGAAGGAIVGGVGY | 0.13 | 3 | 0.40 | 6.01 | 251 |
| F8HFT9 | Pore-forming peptide, putative bacteriocin | VATGVGNGLRLGIKTRTWQGAVAGAAGGAIVGGVGY | 0.13 | 3 | 0.40 | 6.01 | 252 |
| F8LRT1 | Pore-forming peptide, putative bacteriocin | VATGVGNGLRLGIKTRTWQGAVAGAAGGAIVGGVGY | 0.13 | 3 | 0.40 | 6.01 | 253 |

TABLE 3-continued

Representative peptides identifies from the primary screen

| Accession # | Name | Comp Form Match | HM | Q | HMQ | PI | SEQ ID NO: |
|---|---|---|---|---|---|---|---|
| Q5M2W2 | Pore-forming peptide, putative bacteriocin | VATGVGNGLRLGIKTRTWQGAVAGAAGGAIVGGVGY | 0.13 | 3 | 0.40 | 6.01 | 254 |
| A0A086B2P4 | Uncharacterized protein | LKTIKGGGDQGV | 0.39 | 1 | 0.39 | 9.27 | 255 |
| M4YV24 | Hypothetical membrane associated protein | IIGGLGGLASGLKF | 0.38 | 1 | 0.38 | 5.46 | 256 |
| A0A0E2IVJ2 | Uncharacterized protein | IAGGAGNGLRLGIKTRTWQGVVAGAVGGAIIGGVGY | 0.13 | 3 | 0.38 | 8.77 | 257 |
| I0S9I1 | Uncharacterized protein | IAGGAGNGLRLGIKTRTWQGVVAGAVGGAIIGGVGY | 0.13 | 3 | 0.38 | 8.77 | 258 |
| A0A087QC98 | Uncharacterized protein | GGKAVNGFVNGN | 0.37 | 1 | 0.37 | 6.17 | 259 |
| D1YGH0 | Uncharacterized protein | GGKAVNGFVNGN | 0.37 | 1 | 0.37 | 6.17 | 260 |
| A0A077EA21 | Uncharacterized protein | MAQLKGGIKNADG | 0.37 | 1 | 0.37 | 9.05 | 261 |
| A0A077EFY9 | Uncharamcterized protein | MAQLKGGIKNADG | 0.37 | 1 | 0.37 | 9.05 | 262 |
| A0A086A6U3 | Uncharacterized protein | RACTLISSGCAQ | 0.37 | 1 | 0.37 | 8.59 | 263 |
| F8NCK2 | Uncharacterized protein | QKGMSQVRGGVQE | 0.37 | 1 | 0.37 | 5.28 | 264 |
| A0A0F2CQG4 | Uncharacterized protein | SIWKVGGAVVGGATALFA | 0.37 | 1 | 0.37 | 4.2 | 265 |
| A0A0HOYQB5 | Uncharacterized protein | GLGAIARSWAQGGF | 0.35 | 1 | 0.35 | 5.04 | 266 |
| A0A0HOYSB4 | Uncharacterized protein | GLGAIARSWAQGGF | 0.35 | 1 | 0.35 | 5 | 267 |
| K9E1K0 | Uncharacterized protein | CAKSGNAAGAAVMSAH | 0.23 | 1.5 | 0.35 | 8.43 | 268 |
| J3CSM9 | Uncharacterized protein | VRALLGGIIATGSA | 0.35 | 1 | 0.35 | 11.65 | 269 |
| A0A0H2UTD9 | Uncharacterized protein | VIGGLGGLASGLKF | 0.34 | 1 | 0.34 | 6.5 | 270 |
| Q9A137 | Uncharacterized protein | VIGGLGGLASGLKF | 0.34 | 1 | 0.34 | 6.5 | 271 |
| C5WF58 | Hypothetical membrane associated protein | VIGGLGGLASGLKF | 0.34 | 1 | 0.34 | 6.5 | 272 |
| Q1J801 | Hypothetical membrane associated protein | VIGGLGGLASGLKF | 0.34 | 1 | 0.34 | 6.5 | 273 |
| Q1J159 | Hypothetical membmne associated protein | VIGGLGGLASGLKF | 0.34 | 1 | 0.34 | 6.5 | 274 |

TABLE 3-continued

Representative peptides identifies from the primary screen

| Accession # | Name | Comp Form Match | HM | Q | HMQ | PI | SEQ ID NO: |
|---|---|---|---|---|---|---|---|
| Q1JN16 | Hypothetical membmne associated protein | VIGGLGGLASGLKF | 0.34 | 1 | 0.34 | 6.5 | 275 |
| Q48UV8 | Hypothetical membrane associated protein | VIGGLGGLASGLKF | 0.34 | 1 | 0.34 | 6.5 | 276 |
| Q5XDF5 | Hypothetical membrane associated protein | VIGGLGGLASGLKF | 0.34 | 1 | 0.34 | 6.5 | 277 |
| I7J3B0 | Uncharacterized protein | DFWHKLMDSLCRNFNS | 0.68 | 0.5 | 0.34 | 6.54 | 278 |
| F5ZAJ3 | Unchamcterized protein | RGGGWVGAAIGAISGGLG | 0.34 | 1 | 0.34 | 4.4 | 279 |
| G0IAJ6 | Uncharacterized protein | SIWKIGAAVAGGAAALFA | 0.34 | 1 | 0.34 | 4.2 | 280 |
| K0ZN36 | Uncharacterized protein | AAKIAGGITAAG | 0.34 | 1 | 0.34 | 4.08 | 281 |
| K1A1E3 | Uncharacterized protein | AAKIAGGITAAG | 0.34 | 1 | 0.34 | 4.08 | 282 |
| A0A0F3HMF2 | Uncharacterized protein | SIWKVGAAVAGGATALFA | 0.33 | 1 | 0.33 | 4.25 | 283 |
| X8FLG5 | Uncharacterized protein | AAGWKACSSIYGM | 0.33 | 1 | 0.33 | 5.49 | 284 |
| A0A0H8RN19 | Putative transporter | LVSGGIALGSRCG | 0.32 | 1 | 0.32 | 4.89 | 285 |
| A0A0J7IN65 | Uncharacterized protein | TGPKYCSTYIGC | 0.32 | 1 | 0.32 | 9.04 | 286 |
| S6C1D9 | Unchamcterized protein | GLGAIARSWAQGGFA | 0.32 | 1 | 0.32 | 5.04 | 287 |
| A5M594 | Uncharacterized protein | KAIAGGTALIGSGWAAG | 0.31 | 1 | 0.31 | 3.57 | 288 |
| U2EX79 | Uncharacterized protein | TPGGGGDAAAAGVRK | 0.31 | 1 | 0.31 | 7.89 | 289 |
| A51132 | Uncharacterized protein | KVIAGGTALIGSSLAAG | 0.30 | 1 | 0.30 | 3.57 | 290 |
| A0A0B7LKX0 | Excreted peptide | KVIAGGTALIGSSLAAG | 0.30 | 1 | 0.30 | 3.57 | 291 |
| Q6SZ94 | Bacteriocin-type signal sequence-containing protein (MundKS) (Mundticin) | NSAANLATGGAAGWKS | 0.29 | 1 | 0.29 | 9.7 | 292 |
| A0RJ68 | Uncharacterized protein | AGVAGFTKVAGAITAGAG | 0.29 | 1 | 0.29 | 9.52 | 293 |
| B3Z892 | Uncharacterized protein | AGVAGFTKVAGAITAGAG | 0.29 | 1 | 0.29 | 9.52 | 294 |
| C2UP09 | Uncharacterized protein | AGVAGFTKVAGAITAGAG | 0.29 | 1 | 0.29 | 9.7 | 295 |

TABLE 3-continued

Representative peptides identifies from the primary screen

| Accession # | Name | Comp Form Match | HM | Q | HMQ | PI | SEQ ID NO: |
|---|---|---|---|---|---|---|---|
| A0A0H2UN03 | Uncharacterized protein | KAIAGGTALIGSGLAAG | 0.29 | 1 | 0.29 | 3.57 | 296 |
| A0A0H2ZQ92 | Uncharacterized protein | KAIAGGTALIGSGLAAG | 0.29 | 1 | 0.29 | 3.57 | 297 |
| B1I840 | Uncharacterized protein | KAIAGGTALIGSGLAAG | 0.29 | 1 | 0.29 | 3.57 | 298 |
| B2IRL0 | Uncharacterized protein | KAIAGGTALIGSGLAAG | 0.29 | 1 | 0.29 | 3.57 | 299 |
| C1CAF3 | Uncharacterized protein | KAIAGGTALIGSGLAAG | 0.29 | 1 | 0.29 | 3.57 | 300 |
| C1CBU7 | Uncharacterized protein | KAIAGGTALIGSGLAAG | 0.29 | 1 | 0.29 | 3.57 | 301 |
| G0IBD6 | Uncharacterized protein | KAIAGGTALIGSGLAAG | 0.29 | 1 | 0.29 | 3.57 | 302 |
| J1DKQ8 | Uncharacterized protein | KAIAGGTALIGSGLAAG | 0.29 | 1 | 0.29 | 3.57 | 303 |
| Q8CZA0 | Uncharacterized protein | KAIAGGTALIGSGLAAG | 0.29 | 1 | 0.29 | 3.57 | 304 |
| R0N8A8 | Uncharacterized protein | KAIAGGTALIGSGLAAG | 0.29 | 1 | 0.29 | 3.57 | 305 |
| A0A0C1QXM7 | Uncharacterized protein | VILKSMNAVASAFQFIAL | 0.29 | 1 | 0.29 | 4.13 | 306 |
| A0A069P4B0 | Uncharacterized protein | AGGRAVSAIVDGR | 0.28 | 1 | 0.28 | 5.03 | 307 |
| B1BHK0 | Uncharacterized protein | KAVALISAGVTTLAGAAA | 0.28 | 1 | 0.28 | 4.78 | 308 |
| B1BU21 | Uncharacterized protein | KAVALISAGVTTLAGAAA | 0.28 | 1 | 0.28 | 4.78 | 309 |
| B1RC11 | Uncharacterized protein | KAVALISAGVTTLAGAAA | 0.28 | 1 | 0.28 | 4.78 | 310 |
| I7H0S7 | Uncharacterized protein | KAVALISAGVTTLAGAAA | 0.28 | 1 | 0.28 | 4.78 | 311 |
| A0A0D7QJF4 | Uncharacterized protein | LAGKALDALSHATDHTPTNVLNGMLGAIGR | 0.28 | 1 | 0.28 | 4.97 | 312 |
| R7AVY5 | Uncharacterized protein | MKEYAQSASDAKVKQFFEKGAKSA | 0.14 | 2 | 0.27 | 7.88 | 313 |
| A0A0D1B9N5 | Contig000008, whole genome shotgun sequence | SHLPSIFEKFCNWIGM | 0.54 | 0.5 | 0.27 | 9.89 | 314 |
| B1BHJ9 | Uncharacterized protein | TGAAIAKGAAAIGTA | 0.26 | 1 | 0.26 | 6.53 | 315 |
| B1BU20 | Uncharacterized protein | TGAAIAKGAAAIGTA | 0.26 | 1 | 0.26 | 6.53 | 316 |
| B1RC12 | Uncharacterized protein | TGAAIAKGAAAIGTA | 0.26 | 1 | 0.26 | 6.53 | 317 |

TABLE 3-continued

Representative peptides identifies from the primary screen

| Accession # | Name | Comp Form Match | HM | Q | HMQ | PI | SEQ ID NO: |
|---|---|---|---|---|---|---|---|
| I7H937 | Putative bacteriocin | TGAAIAKGAAAIGTA | 0.26 | 1 | 0.26 | 6.53 | 318 |
| E3CPS2 | Uncharacterized protein | HTVYDFGRGFVDGFRG | 0.51 | 0.5 | 0.26 | 6.51 | 319 |
| E8KT24 | Uncharacterized protein | HTVYDFGRGFVDGFRG | 0.51 | 0.5 | 0.26 | 6.51 | 320 |
| T0TQ78 | Uncharacterized protein | HTVYDFGRGFVDGFRG | 0.51 | 0.5 | 0.26 | 8.12 | 321 |
| X8JP08 | Uncharacterized protein | HTVYDFGRGFVDGFRG | 0.51 | 0.5 | 0.26 | 8.12 | 322 |
| E1M7J2 | Unchamcterized protein | KAIAGGTALVGSGLTAG | 0.26 | 1 | 0.26 | 3.71 | 323 |
| D6E340 | Uncharacterized protein | FWTLVAAGFAGGIATGVSR | 0.25 | 1 | 0.25 | 8.14 | 324 |
| A0A0F2CYI7 | Uncharacterized protein | KAIAGGTALVGSGLAAG | 0.25 | 1 | 0.25 | 3.66 | 325 |
| A0A0F2DGV3 | Uncharacterized protein | KAIAGGTALVGSGLAAG | 0.25 | 1 | 0.25 | 3.5 | 326 |
| A0A0F3HMX5 | Uncharacterized protein | KAIAGGTALVGSGLAAG | 0.25 | 1 | 0.25 | 3.71 | 327 |

Class II bacteriocins are typically small, cationic peptides that often contain a conserved leader peptide sequence that is important for downstream processing of the mature peptide. This leader peptide is characterized as having a highly conserved double-glycine motif that has been shown to be essential for proper cleavage of the bacteriocin precursor. Beyond this motif, a number of other residues within the leader sequence are also conserved to varying degrees.

Within the field, it has been assumed that the conservation of these residues was likely due to a specificity of the enzyme that carried out cleavage of the signal peptide domain. This supposition has recently been borne out with the structural characterization of a prototypic ABC transporter, demonstrating that only very small residues, such as glycine, can be accommodated in the cleft containing the active site of this protease. This example also suggested that the enzyme would have strong preferences for specific polar or non-polar residues along the signal peptide template.

In the present study, an alignment of more than 200 prototypic class II bacteriocins was carried out to generate a more relaxed signal peptide consensus sequence. In particular, in addition to the C-terminal double glycine motif, this consensus allowed for any polar residue at positions $-9$ and $-11$ of the signal peptide backbone. Moreover, an expanded set of hydrophobic residues was allowed at positions $-4$ and $-7$, to generate a consensus that may be more representative of a broad number of known bacteriocin sequences.

Once complete, this expanded consensus was used as an initial step within a multi-component search method to probe for new bacteriocin sequences in genomic data templates. This retrieved a large percentage (88-90%) of the currently known class IIa and IIb linear bacteriocins. Hence, the application of this multi-component search method may provide a useful way to rapidly screen new sequence data for the presence of bacteriocin sequences. Such methods may serve as an adjunct to currently used computational gene identification tools as many small peptides are not correctly identified or annotated in current genome sequencing projects.

Beyond the signal peptide consensus screen, a second component of the search method made use of a newly identified amphipathic search formula to probe for ca-helical domains within the retrieved peptide dataset. The tests using this formula have demonstrated that it is highly accurate, identifying alpha-helical domains with greater than 90% efficiency. Application of the amphipathic search formula returned virtually all of the bacteriocins identified in the primary signal peptide-based screen with the exception of the pediocin peptides.

Residue Frequency
Abundance of Glycine and Alanine

Figure 5:
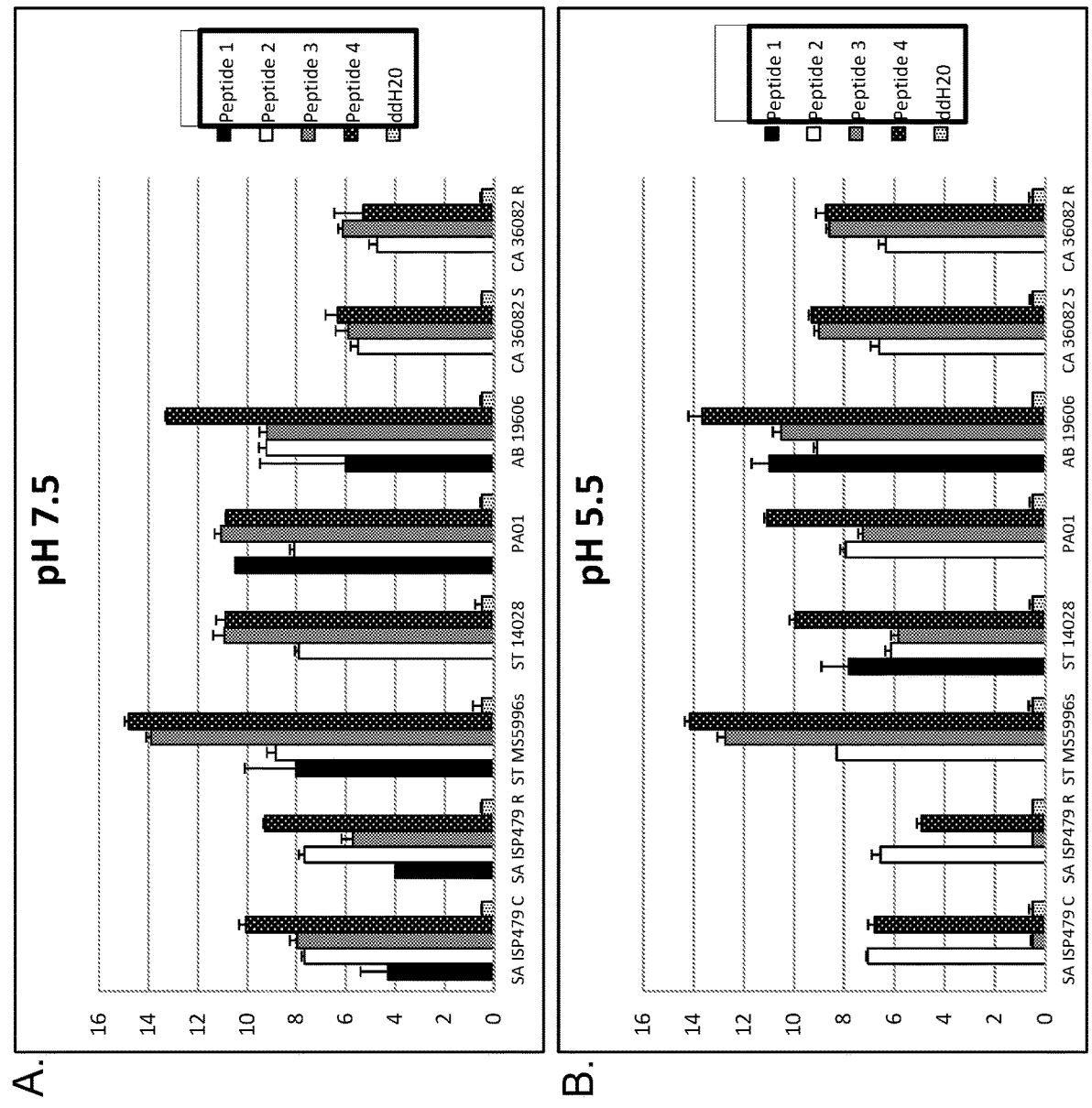
FIG. 5, with panels A and B, shows the antimicrobial activity of putative bacteriocins. Microbicidal activity of study test peptides versus a panel of prototypic gram-positive (*S. aureus*), gram-negative (*S. typhimurium, P. aeruginosa, A. baumannii*) and fungal (*C. albicans*) pathogens at two pH's representing: A—native physiologic (pH 7.5); or B—phagolysosomal (pH 5.5) environments.

As the amphipathic search formula returns aligned datasets, it was possible to determine the frequency of individual residues on both the polar and non-polar faces of a predicted 18 residue $\alpha$-helical span of returned peptides. One outcome of this analysis was the finding that glycine was the most abundant residue at nearly all positions of the polar face of the peptide and, if not the most abundant, then highly represented on the non-polar face of the returned sequences (FIG. 5). It is also of interest that after glycine one of the second most abundant residues at all positions on both peptide faces was alanine.

These findings lend support to one of the reigning theories regarding the mechanism by which many $\alpha$-helical antimicrobial peptides are presumed to limit self-toxicity prior to interacting with their intended target. This theory proposes that an abundance of small, sterically-unrestrained residues with a high degree of rotational freedom, such as glycine and alanine, serve to keep $\alpha$-helical antimicrobial peptides in an unstructured and non-toxic conformation in aqueous environments. Such peptides only then become organized to adopt their microbicidal amphipathic structure when they encounter the hydrophobic milieu of the target membrane. Support for this theory is provided by: 1) the finding of an abundance of glycine, and to a lesser extent alanine, residues in the $\alpha$-helical antimicrobial peptides of many organisms; and 2) a significant number of structural studies which demonstrate that many $\alpha$-helical antimicrobial peptides are unstructured in aqueous solutions only to adopt an $\alpha$-helical conformation in the presence of membrane mimetic environments.

In the current example, the finding of an abundance of glycine and alanine in the retrieved bacteriocins would suggest that these peptides may also utilize a similar mechanism to limit self-toxicity.

Preference of Lysine Over Arginine

One additional mechanism by which $\alpha$-helical antimicrobial peptides are thought to exert their microbicidal effect, is via a relative abundance of cationic residues which are thought to enhance their selectivity towards anionic surface lipids and the increased electronegative potential of many bacterial species. In the present study, a large proportion of the retrieved sequences were cationic in nature, an observation that supports this hypothesis. One additional finding was a strong preference for an abundance of lysine over arginine in the retrieved bacteriocin sequences. While the significance of this observation is not known, it is in alignment with a similar preference for lysine over arginine in many $\alpha$-helical antimicrobial peptides of eukaryotes. Biophysical studies have found that lysine is less efficient at generating negative Gaussian membrane curvature, and pore-like structures, than arginine. However, many $\alpha$-helical antimicrobial peptides have an increased net hydrophobicity, as compared with other more arginine-rich classes of antimicrobial proteins, a feature that may compensate for this reduced permeabilizing efficiency.

Spectrum/Potency

Sequences retrieved by the multi-component sequence formula were screened for a number of biophysical parameters, and based on these findings, and their localization to bacteriocin-like operons, four putative bacteriocin peptides were synthesized and assessed for microbicidal activity. Notably, all four peptides were found to have activity against a broad spectrum of microorganisms, with particular potency against a number of Gram negative pathogens. While historically it was reported that bacteriocin peptides were relatively narrow spectrum antibiotics, being most potent against closely related Gram positive organisms, more recent studies have found that in fact many bacteriocins have a much broader spectrum with microbicidal activity towards Gram negative and fungal organisms as well. These more recent studies reflect what was found in this report where all four putative bacteriocin peptides had activity against Gram positive, Gram negative and fungal organisms.

Unless otherwise defined, all technical and scientific terms used herein have the same meaning as commonly understood by one of ordinary skill in the art to which this disclosure belongs.

The disclosures illustratively described herein may suitably be practiced in the absence of any element or elements, limitation or limitations, not specifically disclosed herein. Thus, for example, the terms "comprising", "including," "containing", etc. shall be read expansively and without limitation. Additionally, the terms and expressions employed herein have been used as terms of description and not of limitation, and there is no intention in the use of such terms and expressions of excluding any equivalents of the features shown and described or portions thereof, but it is recognized that various modifications are possible within the scope of the disclosure claimed.

Thus, it should be understood that although the present disclosure has been specifically disclosed by preferred embodiments and optional features, modification, improvement and variation of the disclosures embodied therein herein disclosed may be resorted to by those skilled in the art, and that such modifications, improvements and variations are considered to be within the scope of this disclosure. The materials, methods, and examples provided here are representative of preferred embodiments, are exemplary, and are not intended as limitations on the scope of the disclosure.

The disclosure has been described broadly and generically herein. Each of the narrower species and subgeneric groupings falling within the generic disclosure also form part of the disclosure. This includes the generic description of the disclosure with a proviso or negative limitation removing any subject matter from the genus, regardless of whether or not the excised material is specifically recited herein.

In addition, where features or aspects of the disclosure are described in terms of Markush groups, those skilled in the art will recognize that the disclosure is also thereby described in terms of any individual member or subgroup of members of the Markush group.

All publications, patent applications, patents, and other references mentioned herein are expressly incorporated by reference in their entirety, to the same extent as if each were incorporated by reference individually. In case of conflict, the present specification, including definitions, will control.

It is to be understood that while the disclosure has been described in conjunction with the above embodiments, that the foregoing description and examples are intended to illustrate and not limit the scope of the disclosure. Other aspects, advantages and modifications within the scope of the disclosure will be apparent to those skilled in the art to which the disclosure pertains.

---

SEQUENCE LISTING (1884 sequences)

SEQ ID NO: 1 - protein, 15 aa, Bacillus thuringiensis (strain Al Hakam)
EWGKQLGKWIGSKIK

SEQ ID NO: 2 - protein, 22 aa, [Eubacterium] rectale DSM 17629
KYVKNYLDFIKKAIDIFRPMPI

SEQ ID NO: 3 - protein, 15 aa, Bacillus cereus 03BB108
KWAKSAGKWIASKIK

SEQ ID NO: 4 - protein, 21 aa, Enterococcus pallens ATCC BAA-351
KIGKTVGTIVRKGFEIWSIFK

SEQ ID NO: 5 - protein, 28 aa, Bacillus thuringiensis (strain Al Hakam)
FKVIVTDAGHYPREWGKQLGKWIGSKIK

SEQ ID NO: 6 - protein, 29 aa, [Eubacterium] rectale DSM 17629
KRNYSIEKYVKNYLDFIKKAIDIFRPMPI

SEQ ID NO: 7 - protein, 27 aa, Bacillus cereus 03BB108
KTIATNATYYPNKWAKSAGKWIASKIK

SEQ ID NO: 8 - protein, 28 aa, Enterococcus pallens ATCC BAA-351
QYDKTGYKIGKTVGTIVRKGFEIWSIFK

SEQ ID NO: 9 - protein, 17 aa, Microscilla marina ATCC 23134
RQMVRHLRRFMRRYGRC

SEQ ID NO: 10 - protein, 14 aa, Lactobacillus hokkaidonensis JCM 18461
KNGLKKFFKWVRKL

SEQ ID NO: 11 - protein, 18 aa, Clostridium cellulovorans (strain ATCC 35296 / DSM 3052 / OCM 3 / 743B)
SLKKALKKAVSGLGKIIK

SEQ ID NO: 12 - protein, 13 aa, Lactobacillus plantarum
KTLTKFFKSLIKR

SEQ ID NO: 13 - protein, 12 aa, Bacteroides oleiciplenus YIT 12058
RCRKVYHRLWGK

SEQ ID NO: 14 - protein, 15 aa, Clostridium cellulovorans (strain ATCC 35296 / DSM 3052 / OCM 3 / 743B)
SLRKALKKIIDAIVK

SEQ ID NO: 15 - protein, 13 aa, Lactobacillus equicursoris 66c
SQLYKNLFKVFRK

SEQ ID NO: 16 - protein, 19 aa, Lactobacillus plantarum subsp. plantarum
LQMGATAIKQVKKLFKKWG

SEQ ID NO: 17 - protein, 15 aa, Providencia rustigianii DSM 4541
YKNVKAFIEKCRKVY

SEQ ID NO: 18 - protein, 13 aa, Lactobacillus sakei subsp. sakei (strain 23K)
REYLNKITKWIKH

SEQ ID NO: 19 - protein, 13 aa, Bacillus cereus BDRD-ST26
WIGKVGKQYKKAT

SEQ ID NO: 20 - protein, 31 aa, Clostridium sp. CAG:1193
GSIISSIVRGGILILELGRSFGSALRRLLKK

SEQ ID NO: 21 - protein, 15 aa, Streptococcus infantarius subsp. infantarius ATCC BAA-102
RQAAKAIGKAVGKLF

SEQ ID NO: 22 - protein, 22 aa, Prevotella sp. F0091
MRNGFEIFKKIAKSIIDAFRHA

SEQ ID NO: 23 - protein, 21 aa, Enterococcus pallens ATCC BAA-351
AVGKNVWEFGKGFVKGWNKAK

SEQ ID NO: 24 - protein, 22 aa, Enterococcus pallens ATCC BAA-351
KTGYKIGKTVGTIVRKGFEIWS

SEQ ID NO: 25 - protein, 12 aa, Lactobacillus crispatus CTV-05
GGSKGWNKFWKS

SEQ ID NO: 26 - protein, 12 aa, Lactobacillus crispatus FB077-07
GGSKGWNKFWKS

SEQ ID NO: 27 - protein, 16 aa, Lactobacillus plantarum subsp. plantarum ATCC 14917 = JCM 1149 = CGMCC 1.2437
GGGAWKNFWSSLRKGF

SEQ ID NO: 28 - protein, 14 aa, Lactobacillus plantarum 16
KQWYRLGERVGRVA

SEQ ID NO: 29 - protein, 13 aa, Streptococcus agalactiae (strain ATCC 13813 / DSM 2134 / JCM 5671 / NCIMB 701348 / NCTC 8181)
GSACAYMRRVCKK

SEQ ID NO: 30 - protein, 13 aa, Streptococcus peroris ATCC 700780
RRITSFFANLFQK

SEQ ID NO: 31 - protein, 13 aa, Nitrococcus mobilis Nb-231
QKAMKNIRGGARG

SEQ ID NO: 32 - protein, 15 aa, Streptococcus mitis (strain B6)
VKWCNKLFGTGRHVA

SEQ ID NO: 33 - protein, 29 aa, Lactobacillus brevis subsp. gravesensis ATCC 27305
LSHISGGVTRYRHHEKKSWIDDFMKGFKK

SEQ ID NO: 34 - protein, 12 aa, Streptococcus mitis SK616
SITNFWKKYFNH

SEQ ID NO: 35 - protein, 12 aa, Streptococcus mitis SK579
SITNFWKKYFNH

SEQ ID NO: 36 - protein, 15 aa, Lactobacillus ruminis CAG:367
YNPFKNIFHRFSNGH

SEQ ID NO: 37 - protein, 13 aa, Providencia sneebia DSM 19967
YKNVKAFIEKCRS

SEQ ID NO: 38 - protein, 18 aa, Streptococcus pseudopneumoniae (strain IS7493)
GRFFGGIYNAGRSFGRNV

SEQ ID NO: 39 - protein, 18 aa, Streptococcus pseudopneumoniae 22725
GRFFGGIYNAGRSFGRNV

SEQ ID NO: 40 - protein, 12 aa, Streptococcus intermedius F0395
RGIIGIGKKLFG

SEQ ID NO: 41 - protein, 29 aa, Clostridium sp. CAG:451
GTILNQLNKLISILVDSGKSLGSSIRRIS

SEQ ID NO: 42 - protein, 28 aa, Bacillus cereus 03BB108
INGGKTIATNATYYPNKWAKSVGKWIAS

SEQ ID NO: 43 - protein, 13 aa, Lactobacillus curvatus CRL 705
SNFIHKIKQIFTH

SEQ ID NO: 44 - protein, 13 aa, Lactobacillus acidophilus (strain ATCC 700396 / NCK56 / N2 / NCFM)
IGGSAKSYIRRLG

SEQ ID NO: 45 - protein, 31 aa, Clostridium sp. CAG:433
GSLFSALAKGFNVFVDMGRALGSSIRRLVNN

SEQ ID NO: 46 - protein, 29 aa, Lactobacillus buchneri ATCC 11577
LSHISGGVTRYRYHEKKSWIDDFMKGFKK

SEQ ID NO: 47 - protein, 29 aa, Lactobacillus hilgardii DSM 20176 = ATCC 8290
LSHISGGVTRYRYHEKKSWIDDFMKGFKK

SEQ ID NO: 48 - protein, 29 aa, Mycoplasma sp. CAG:611
AAFINGVKGIFSIFFDFGNSLGSSIRRIK

SEQ ID NO: 49 - protein, 12 aa, Streptococcus anginosus T5
RGMIGIGKKLFG

SEQ ID NO: 50 - protein, 29 aa, Firmicutes bacterium CAG:822
ATFINAIVKGLSLIIELGKSLGSSFRRIT

SEQ ID NO: 51 - protein, 28 aa, Bacillus cereus 03BB108
INGGKTIATNATYYPNKWAKSAGKWIAS

SEQ ID NO: 52 - protein, 27 aa, Anaerococcus hydrogenalis DSM 7454
QIYKEAKDFVNNRAGNLIRGFKDVWKN

SEQ ID NO: 53 - protein, 13 aa, Virgibacillus sp. SK37
LSRVKGGMSRIAG

SEQ ID NO: 54 - protein, 12 aa, Bacillus cereus m1293
KWGKELGRWIGS

SEQ ID NO: 55 - protein, 13 aa, Bacillus thuringiensis (strain Al Hakam)
REWGKQLGKWIGS

SEQ ID NO: 56 - protein, 16 aa, Desulfosporosinus sp. OT
SGGGKFIGNLIKLARP

SEQ ID NO: 57 - protein, 13 aa, Prevotella dentalis (strain ATCC 49559 / DSM 3688 / JCM 13448 / NCTC 12043 / ES 2772) (Mitsuokella dentalis)
LRFLDRIMGGFRQ

SEQ ID NO: 58 - protein, 12 aa, Sphaerotilus natans subsp. natans DSM 6575
FGGLLRHLFGFK

SEQ ID NO: 59 - protein, 12 aa, Streptomyces aurantiacus JA 4570
LPNLGRRMVGAW

SEQ ID NO: 60 - protein, 19 aa, Lactobacillus salivarius GJ-24
LSHVNGGYNRLAGRIGHYT

SEQ ID NO: 61 - protein, 14 aa, Blastomonas sp. CACIA14H2
IGGLLGGIFGLLRK

SEQ ID NO: 62 - protein, 14 aa, Tannerella forsythia KS16
RNGARIAGRLVGIA

SEQ ID NO: 63 - protein, 14 aa, Tannerella forsythia (strain ATCC 43037 / JCM 10827 / FDC 338) (Bacteroides forsythus)
RNGARIAGRLVGIA

SEQ ID NO: 64 - protein, 12 aa, Actinoplanes sp. N902-109
ANHANGLFRRVL

SEQ ID NO: 65 - protein, 13 aa, Kordia algicida OT-1
FSKLQKLIGGVEK

SEQ ID NO: 66 - protein, 12 aa, Nitrosococcus halophilus (strain Nc4)
AARRAFASGRKA

SEQ ID NO: 67 - protein, 28 aa, Streptococcus mitis
GIAGVLNAAVQIFNAGYKFGSDFARRGR

SEQ ID NO: 68 - protein, 28 aa, Streptococcus infantis
GIAGVLNAAVQIFNAGYKFGSDFARRGR

SEQ ID NO: 69 - protein, 28 aa, Streptococcus pseudopneumoniae (strain IS7493)
GIAGVLNAAVQIFNAGYKFGSDFARRGR

SEQ ID NO: 70 - protein, 14 aa, Chryseobacterium sp. JM1
GKSCWKILKDLIGL

SEQ ID NO: 71 - protein, 28 aa, Streptococcus oralis subsp. oralis
GIAGVLNAAVQIFNAGYKFGSDLARRGR

SEQ ID NO: 72 - protein, 20 aa, Faecalibacterium prausnitzii M21/2
IGKVFNYIARIFSGASSIIN

SEQ ID NO: 73 - protein, 20 aa, Faecalibacterium prausnitzii SL3/3
IGKVFNYIARIFSGASSIIN

SEQ ID NO: 74 - protein, 22 aa, Leuconostoc mesenteroides subsp. mesenteroides (strain ATCC 8293 / NCDO 523)
VAKDAWNHLDQIRSGWRKAGNS

SEQ ID NO: 75 - protein, 18 aa, Prochlorococcus sp. MIT 0701
KTYKKVAKKIEDYVDNGP

SEQ ID NO: 76 - protein, 16 aa, Streptococcus salivarius (strain 57.I)
FSSGYKFGTDLARRGR

SEQ ID NO: 77 - protein, 16 aa, Streptococcus salivarius (strain CCHSS3)
FSSGYKFGTDLARRGR

SEQ ID NO: 78 - protein, 14 aa, Streptococcus sp. HSISB1
TTLLTGVFGWLKKF

SEQ ID NO: 79 - protein, 20 aa, Faecalibacterium prausnitzii A2-165
VGKLFNYIARVFSAGSSIVN

SEQ ID NO: 80 - protein, 13 aa, Prevotella multisaccharivorax DSM 17128
IDSFKKGADKANR

SEQ ID NO: 81 - protein, 12 aa, Elizabethkingia anophelis NUHP1
KKGLRQITGGME

SEQ ID NO: 82 - protein, 18 aa, Faecalibacterium cf. prausnitzii KLE1255
NVGKVFNAIARIFSGASS

SEQ ID NO: 83 - protein, 28 aa, Desulfotomaculum gibsoniae DSM 7213
VKNLFNQISQVQQKTAQEFQQMMNKFPQ

SEQ ID NO: 84 - protein, 18 aa, Streptococcus sobrinus W1703
GGNWINVFKSVVDIARRG

SEQ ID NO: 85 - protein, 18 aa, Candidatus Woesebacteria bacterium GW2011_GWA2_33_28
TSLESLGSRARRVLKEIS

SEQ ID NO: 86 - protein, 29 aa, Bacillus sp. CAG:988
GSLLNAFVDILKVLLDAGRSVGSGIRRAT

SEQ ID NO: 87 - protein, 39 aa, Lactobacillus paraplantarum
KTLATVIGGGKGGGILSWFIGESSDIWKGFKKGMNHYNK

SEQ ID NO: 88 - protein, 39 aa, Lactobacillus plantarum AY01; identical to SEQ ID NO: 87

SEQ ID NO: 89 - protein, 27 aa, Firmicutes bacterium CAG:884
GSILNSFIRYVNVFFEIGQAFGSAIRR

SEQ ID NO: 90 - protein, 15 aa, Staphylococcus epidermidis
GEKIGKLLREVREAK

SEQ ID NO: 91 - protein, 15 aa, Lactobacillus salivarius GJ-24
IVQGAVAVFKSGYRH

SEQ ID NO: 92 - protein, 17 aa, Dolosigranulum pigrum ATCC 51524
TVGGSYSSACKRVWNAK

SEQ ID NO: 93 - protein, 26 aa, Mycoplasma sp. CAG:956
ATFFNALARSLSTISDIGRSLGTAIR

SEQ ID NO: 94 - protein, 26 aa, Firmicutes bacterium CAG:582
TQMINSFVKLVSTLLDLGRTMGSALR

SEQ ID NO: 95 - protein, 29 aa, Clostridium sp. CAG:524
SVGTIINAVVKAISLLNELGQQLGSAIRR

SEQ ID NO: 96 - protein, 12 aa, Vibrio galatheae
SGPAWLSRYLHK

SEQ ID NO: 97 - protein, 15 aa, Lactobacillus acidophilus (strain ATCC 700396 / NCK56 / N2 / NCFM)
VGRGLWENLSNIFKH

SEQ ID NO: 98 - protein, 13 aa, Streptococcus infantarius subsp. infantarius
THLLAGLWDWFKR

SEQ ID NO: 99 - protein, 14 aa, Lachnospiraceae bacterium 28-4
SSVKQFFEKGARSA

SEQ ID NO: 100 - protein, 12 aa, Burkholderia sp. (strain CCGE1003)
AAHRAIAKVAAT

SEQ ID NO: 101 - protein, 12 aa, Clostridium botulinum (strain Langeland / NCTC 10281 / Type F)
TGFYNGYRNAGR

SEQ ID NO: 102 - protein, 12 aa, Vibrio tubiashii
SGPAWLNRYLNK

SEQ ID NO: 103 - protein, 12 aa, Vibrio sp. VPAP30
SGPAWLNRYLNK

SEQ ID NO: 104 - protein, 12 aa, Vibrio tubiashii ATCC 19109
SGPAWLNRYLNK

SEQ ID NO: 105 - protein, 15 aa, Firmicutes bacterium CAG:65
KVKQFFEKGARSAME

SEQ ID NO: 106 - protein, 15 aa, Clostridium sp. CAG:91
KVKQFFEKGARSAME

SEQ ID NO: 107 - protein, 18 aa, Enterococcus faecium EnGen0191
NNLSKGGAKCGAAIAGGL

SEQ ID NO: 108 - protein, 40 aa, Chryseobacterium sp. JM1
KEILTHVKGGAAGSGYINTVSGECNSSGRSCWKALKDLLG

SEQ ID NO: 109 - protein, 16 aa, Sphingobacterium paucimobilis HER1398
QGGGVIGRLIKAAANA

SEQ ID NO: 110 - protein, 20 aa, Staphylococcus microti
GWAGRIAGKVAGGVRSLADG

SEQ ID NO: 111 - protein, 14 aa, Lachnospiraceae bacterium 10-1
TQVKQFFEKGAKSA

SEQ ID NO: 112 - protein, 16 aa, Lactobacillus brevis ATCC 14869 = DSM 20054
QQLVTLIRGGCAKIIA

SEQ ID NO: 113 - protein, 22 aa, Commensalibacter intestini A911
ANIIRTGLKNGDNWATIGKNIG

SEQ ID NO: 114 - protein, 35 aa, Firmicutes bacterium CAG:460
LDSINGGGKKLWYLLGAGLSFFLGLFSGLVNPVKC

SEQ ID NO: 115 - protein, 14 aa, Clostridium sp. CAG:448
MKTCKGCGASILST

SEQ ID NO: 116 - protein, 12 aa, Vibrio orientalis CIP 102891 = ATCC 33934
NGPAWLNRYLTK

SEQ ID NO: 117 - protein, 39 aa, Algoriphagus machipongonensis
VSTARKLGRDFGDFLAYCAVVSIFIADAAKDAIKTFTKL

SEQ ID NO: 118 - protein, 12 aa, Caballeronia mineralivorans PML1(12)
QALRSYAKPAGS

SEQ ID NO: 119 - protein, 19 aa, Streptococcus agalactiae (strain ATCC 13813 / DSM 2134 / JCM 5671 / NCIMB 701348 / NCTC 8181)
LKSIKGGGDTVFDKVNHFF

SEQ ID NO: 120 - protein, 19 aa, Streptococcus suis 6407
LKSIKGGGDTVFDKVNHFF

SEQ ID NO: 121 - protein, 15 aa, Gallibacterium anatis
SISSGLTAGYSLVRR

SEQ ID NO: 122 - protein, 15 aa, Gallibacterium anatis 12656/12
SISSGLTAGYSLVRR

SEQ ID NO: 123 - protein, 13 aa, Streptococcus sp. ACS2
VINEFVKGFRQAW

SEQ ID NO: 124 - protein, 13 aa, Streptococcus salivarius
VINEFVKGFRQAW

SEQ ID NO: 125 - protein, 16 aa, Caldicellulosiruptor kristjanssonii (strain ATCC 700853 / DSM 12137 / I77R1B)
LGKLYKWITNVIDNIF

SEQ ID NO: 126 - protein, 15 aa, Lactobacillus ruminis (strain ATCC 27782 / RF3)
SVNRWGAAVGTGGKA

SEQ ID NO: 127 - protein, 13 aa, Chryseobacterium sp. StRB126
KGGNKAITPVREG

SEQ ID NO: 128 - protein, 15 aa, Clostridium argentinense CDC 2741
IYDGVKAAVNKLAHT

SEQ ID NO: 129 - protein, 14 aa, Saccharopolyspora rectivirgula
QRVHAACNELLRGQ

SEQ ID NO: 130 - protein, 25 aa, Eubacterium ramulus ATCC 29099
GDSYLQKLTGIRRHRLRALFGGGEE

SEQ ID NO: 131 - protein, 13 aa, Streptococcus vestibularis F0396
VINEFVKGFHHAW

SEQ ID NO: 132 - protein, 13 aa, Streptococcus vestibularis ATCC 49124
VINEFVKGFHHAW

SEQ ID NO: 133 - protein, 12 aa, Lactococcus raffinolactis 4877
AGYTIGKDIAKR

SEQ ID NO: 134 - protein, 12 aa, Bacteroides fragilis str. DS-208
YNKMEKILEKLS

SEQ ID NO: 135 - protein, 12 aa, Bacteroides fragilis str. 2-F-2 #4
YNKMEKILEKLS

SEQ ID NO: 136 - protein, 12 aa, Bacteroides fragilis str. S36L11
YNKMEKILEKLS

SEQ ID NO: 137 - protein, 12 aa, Bacteroides fragilis str. 20793-3
YNKMEKILEKLS

SEQ ID NO: 138 - protein, 12 aa, Bacteroides fragilis str. S6L5
YNKMEKILEKLS

SEQ ID NO: 139 - protein, 12 aa, Bacteroides fragilis CL07T12C05
YNKMEKILEKLS

SEQ ID NO: 140 - protein, 12 aa, Bacteroides fragilis HMW 610
YNKMEKILEKLS

SEQ ID NO: 141 - protein, 12 aa, Bacteroides fragilis HMW 616
YNKMEKILEKLS

SEQ ID NO: 142 - protein, 18 aa, [Eubacterium] rectale DSM 17629
SIEKYVKNYLDFIKKAID

SEQ ID NO: 143 - protein, 13 aa, Haliscomenobacter hydrossis (strain ATCC 27775 / DSM 1100 / LMG 10767 / O)
HKVADTYNAIAKT

SEQ ID NO: 144 - protein, 14 aa, Bacteroides pyogenes F0041
GGNIFKSIWNWIKE

SEQ ID NO: 145 - protein, 27 aa, Bacillus thuringiensis (strain Al Hakam)
VIGIIAGGAAIIDYGNDFVKGAKKGAK

SEQ ID NO: 146 - protein, 13 aa, Bacteroides oleiciplenus YIT 12058
ARGAKEAVDRIRI

SEQ ID NO: 147 - protein, 14 aa, Elizabethkingia miricola (Chryseobacterium miricola)
APGGCRSIAGAGPK

SEQ ID NO: 148 - protein, 14 aa, Elizabethkingia anophelis 502
APGGCRSIAGAGPK

SEQ ID NO: 149 - protein, 12 aa, Streptococcus sp. HSISS3
SWANYLSRYLKE

SEQ ID NO: 150 - protein, 16 aa, Caldicellulosiruptor saccharolyticus (strain ATCC 43494 / DSM 8903 / Tp8T 6331)
LGKAYKWIANLIESIF

SEQ ID NO: 151 - protein, 14 aa, Elizabethkingia anophelis NUHP1
APGGCRSLAGAGPK

SEQ ID NO: 152 - protein, 14 aa, Legionella fallonii LLAP-10
SGGNRVHEGFDRMR

SEQ ID NO: 153 - protein, 28 aa, Cystobacter fuscus DSM 2262
GGGRGGRDGRGGRGGRGGRGGRGGRGGY

SEQ ID NO: 154 - protein, 16 aa, Providencia rettgeri DSM 1131
NRLVQVVGGWLHSFAL

SEQ ID NO: 155 - protein, 16 aa, Providencia rettgeri DSM 1131
NRLVQVVGGWLHSFAL

SEQ ID NO: 156 - protein, 12 aa, Prochlorococcus sp. MIT 0701
YKKVANYLREID

SEQ ID NO: 157 - protein, 11 aa, Streptococcus equi subsp. zooepidemicus (strain MGCS10565)
KVVKWVAGFFE

SEQ ID NO: 158 - protein, 11 aa, Streptococcus equi subsp. zooepidemicus Sz4is
KVVKWVAGFFE

SEQ ID NO: 159 - protein, 11 aa, Streptococcus equi subsp. zooepidemicus SzAM60
KVVKWVAGFFE

SEQ ID NO: 160 - protein, 11 aa, Streptococcus equi subsp. zooepidemicus Sz16
KVVKWVAGFFE

SEQ ID NO: 161 - protein, 11 aa, Streptococcus equi subsp. zooepidemicus (strain H70)
KVVKWVAGFFE

SEQ ID NO: 162 - protein, 14 aa, Streptococcus agalactiae
GGGWIDGIKKIINL

SEQ ID NO: 163 - protein, 36 aa, Echinicola vietnamensis (strain DSM 17526 / LMG 23754 / KMM 6221)
AGIGAALFSSLIVTGGGMMSVGYSCGNKVKNGLRDY

SEQ ID NO: 164 - protein, 14 aa, Sphingobacterium deserti
GYEVGKSAAERARR

SEQ ID NO: 165 - protein, 14 aa, Leuconostoc kimchii (strain IMSNU 11154 / KCTC 2386 / IH25)
GGDVVKTLTRLFNQ

SEQ ID NO: 166 - protein, 14 aa, Clostridium pasteurianum DSM 525 = ATCC 6013
GGGIYDKINKFLSN

SEQ ID NO: 167 - protein, 22 aa, Chryseobacterium sp. CF314
LRTVTGGLEDCINPATGGCRKI

SEQ ID NO: 168 - protein, 30 aa, Streptococcus pneumoniae (strain JJA)
AALGCAAGGVKYGKILGPWGAAIGGIGGAV

SEQ ID NO: 169 - protein, 14 aa, Prevotella multisaccharivorax DSM 17128
LGRGLGCGRGCGGC

SEQ ID NO: 170 - protein, 19 aa, Desulfovibrio vulgaris (strain Hildenborough / ATCC 29579 / DSM 644 / NCIMB 8303)
GGVLRRCWRDWLDSFFAVQ

SEQ ID NO: 171 - protein, 30 aa, Streptococcus pneumoniae GA47502
AALGCAAGGVKYGRLLGPWGAAIGGIGGAV

SEQ ID NO: 172 - protein, 12 aa, Lactobacillus salivarius DSM 20555 = ATCC 11741
NFGKSYYGKCSF

SEQ ID NO: 173 - protein, 12 aa, Streptococcus pneumoniae
GYIGGGNHLCKG

SEQ ID NO: 174 - protein, 12 aa, Streptococcus pneumoniae
GYIGGGNHLCKG

SEQ ID NO: 175 - protein, 12 aa, Streptococcus mitis
GYIGGGNHLCKG

SEQ ID NO: 176 - protein, 12 aa, Streptococcus pneumoniae
GYIGGGNHLCKG

SEQ ID NO: 177 - protein, 12 aa, Streptococcus pneumoniae
GYIGGGNHLCKG

SEQ ID NO: 178 - protein, 12 aa, Streptococcus pneumoniae SP6-BS73
GYIGGGNHLCKG

SEQ ID NO: 179 - protein, 12 aa, Streptococcus pneumoniae SP14-BS69
GYIGGGNHLCKG

SEQ ID NO: 180 - protein, 12 aa, Streptococcus pneumoniae (strain 70585)
GYIGGGNHLCKG

SEQ ID NO: 181 - protein, 12 aa, Streptococcus pneumoniae (strain JJA)
GYIGGGNHLCKG

SEQ ID NO: 182 - protein, 12 aa, Streptococcus pneumoniae serotype A19 (strain TCH8431)
GYIGGGNHLCKG

SEQ ID NO: 183 - protein, 12 aa, Streptococcus sp. oral taxon 071 str. 73H25AP
GYIGGGNHLCKG

SEQ ID NO: 184 - protein, 12 aa, Streptococcus pneumoniae GA44500
GYIGGGNHLCKG

SEQ ID NO: 185 - protein, 12 aa, Streptococcus pneumoniae PCS8203
GYIGGGNHLCKG

SEQ ID NO: 186 - protein, 12 aa, Streptococcus pneumoniae PCS8106
GYIGGGNHLCKG

SEQ ID NO: 187 - protein, 12 aa, Streptococcus pneumoniae PNI0446
GYIGGGNHLCKG

SEQ ID NO: 188 - protein, 12 aa, Streptococcus pneumoniae (strain ATCC BAA-255 / R6)
GYIGGGNHLCKG

SEQ ID NO: 189 - protein, 12 aa, Streptococcus oralis subsp. tigurinus 2426
GYIGGGNHLCKG

SEQ ID NO: 190 - protein, 12 aa, Streptococcus mitis 27/7
GYIGGGNHLCKG

SEQ ID NO: 191 - protein, 12 aa, Streptococcus pseudopneumoniae 5247
GYIGGGNHLCKG

SEQ ID NO: 192 - protein, 14 aa, Serratia fonticola
GTSAVTVCRRVATC

SEQ ID NO: 193 - protein, 14 aa, Serratia fonticola AU-AP2C
GTSAVTVCRRVATC

SEQ ID NO: 194 - protein, 15 aa, Streptococcus uberis (strain ATCC BAA-854 / 0140J)
GGLGGLQTGIKYCKV

SEQ ID NO: 195 - protein, 30 aa, Streptococcus equi subsp. zooepidemicus SzAM60
GAIGCASRGVKLGSRIGPWGAVIGGVGSAA

SEQ ID NO: 196 - protein, 30 aa, Streptococcus equi subsp. zooepidemicus Sz16; identical to SEQ ID NO: 195

SEQ ID NO: 197 - protein, 30 aa, Streptococcus equi subsp. zooepidemicus Sz4is; identical to SEQ ID NO: 195

SEQ ID NO: 198 - protein, 30 aa, Streptococcus equi subsp. zooepidemicus (strain H70); identical to SEQ ID NO: 195

SEQ ID NO: 199 - protein, 13 aa, Blautia hydrogenotrophica DSM 10507
MEKVSGGASRYQH

SEQ ID NO: 200 - protein, 13 aa, Blautia hydrogenotrophica CAG:147
MEKVSGGASRYQH

SEQ ID NO: 201 - protein, 16 aa, Ruminococcus sp. CAG:382
IDGYCSKCAEKIRNGQ

SEQ ID NO: 202 - protein, 30 aa, Streptococcus pneumoniae (strain 70585)
AALGCAAGGVKYGRLLGLWGAAIGGIGGAV

SEQ ID NO: 203 - protein, 12 aa, Leminorella grimontii ATCC 33999 = DSM 5078
TTLSQFFSKLFG

SEQ ID NO: 204 - protein, 14 aa, Weissella paramesenteroides ATCC 33313
VKSLLGLLGGIMGM

SEQ ID NO: 205 - protein, 13 aa, Pseudodesulfovibrio piezophilus (strain DSM 21447 / JCM 15486 / C1TLV30) (Desulfovibrio piezophilus)
EILKGGKTLVTPL

SEQ ID NO: 206 - protein, 13 aa, Legionella oakridgensis ATCC 33761 = DSM 21215
LSKVSGGASQMTH

SEQ ID NO: 207 - protein, 15 aa, Lactobacillus acidophilus (strain ATCC 700396 / NCK56 / N2 / NCFM)
GSGRGGGAQMRAIGS

SEQ ID NO: 208 - protein, 19 aa, Faecalibacterium sp. CAG:82
TLFNYIARVFSAGSSIINN

SEQ ID NO: 209 - protein, 13 aa, Streptococcus pneumoniae serotype 4 (strain ATCC BAA-334 / TIGR4)
SGYIGGGNHLCKG

SEQ ID NO: 210 - protein, 15 aa, Synechococcus sp. (strain ATCC 27167 / PCC 6312)
QLTGGFRSYGRQLDG

SEQ ID NO: 211 - protein, 13 aa, Enterococcus faecium EnGen0263
TAKQCLQAIGSWG

SEQ ID NO: 212 - protein, 18 aa, Firmicutes bacterium CAG:460
ASFFNSVARILRTAYDIG

SEQ ID NO: 213 - protein, 26 aa, Firmicutes bacterium CAG:321
SMLTAIYKTLEVIYQIGESLGNYIRR

SEQ ID NO: 214 - protein, 13 aa, Lactobacillus sakei subsp. sakei (strain 23K)
GLGKLVRAGVDIG

SEQ ID NO: 215 - protein, 13 aa, Lactobacillus sakei
GLGKLVRAGVDIG

SEQ ID NO: 216 - protein, 15 aa, Bacillus hemicellulosilyticus JCM 9152
LLGLCTGFYGVYKTV

SEQ ID NO: 217 - protein, 12 aa, Lactococcus garvieae
AGLGNGLKQWNT

SEQ ID NO: 218 - protein, 13 aa, Leuconostoc citreum LBAE C10
VVSFGKGIVSAFG

SEQ ID NO: 219 - protein, 27 aa, Clostridium sp. CAG:302
ATMMNAIYKTIEIIFNIGEAFGSYIRR

SEQ ID NO: 220 - protein, 13 aa, Chryseobacterium sp. JM1
GECRKYGRGCAEQ

SEQ ID NO: 221 - protein, 22 aa, Clostridium sp. CAG:914
MINALTKAVTALYDLGKGFGSA

SEQ ID NO: 222 - protein, 20 aa, Acholeplasma sp. CAG:878
ASFLNAISRGIETFLNLGRM

SEQ ID NO: 223 - protein, 19 aa, Lactobacillus johnsonii DPC 6026
VLSAASGAGTGIKACKSFG

SEQ ID NO: 224 - protein, 15 aa, Bacillus akibai (strain ATCC 43226 / DSM 21942 / JCM 9157 / 1139)
LFGLATGFYGVYRAI

SEQ ID NO: 225 - protein, 15 aa, Bacteroides salyersiae CL02T12C01
YEKINGVLTRVFTFS

SEQ ID NO: 226 - protein, 14 aa, Streptococcus salivarius
ATVNTVVNGWMRYG

SEQ ID NO: 227 - protein, 14 aa, Streptococcus sp. HSISS3
ATVNTVVNGWMRYG

SEQ ID NO: 228 - protein, 14 aa, Streptococcus vestibularis F0396
ATVNTVVNGWMKYG

SEQ ID NO: 229 - protein, 17 aa, Bacillus cereus VD078
RIVTALSAFFTSGFTVL

SEQ ID NO: 230 - protein, 14 aa, Streptococcus mitis
MGQGALNSYRDAWK

SEQ ID NO: 231 - protein, 14 aa, Streptococcus mitis SK321
MGQGALNSYRDAWK

SEQ ID NO: 232 - protein, 15 aa, [Clostridium] hylemonae DSM 15053
EVKKLFQDAANSAMK

SEQ ID NO: 233 - protein, 16 aa, Streptococcus intermedius B196
AKSGIAGGAGNGLRLG

SEQ ID NO: 234 - protein, 14 aa, Halobacteroides halobius (strain ATCC 35273 / DSM 5150 / MD-1)
KAMVKDGWKLIETA

SEQ ID NO: 235 - protein, 12 aa, Elizabethkingia miricola (Chryseobacterium miricola)
GKLRAWGGGCDS

SEQ ID NO: 236 - protein, 13 aa, Streptococcus sp. oral taxon 056 str. F0418
WGVFKSVIGTFGP

SEQ ID NO: 237 - protein, 13 aa, Chryseobacterium sp. JM1
CANGVCRPIAGAG

SEQ ID NO: 238 - protein, 15 aa, Corynebacterium efficiens (strain DSM 44549 / YS-314 / AJ 12310 / JCM 11189 / NBRC 100395)
GGGGIARELATMLRP

SEQ ID NO: 239 - protein, 16 aa, Bradyrhizobium sp. S23321
HDGLKVAEAIIKAITH

SEQ ID NO: 240 - protein, 33 aa, Streptococcus salivarius SK126
NGGGILSSVAGLVKDTWGTLYSTGRDFGRSVVN

SEQ ID NO: 241 - protein, 21 aa, Butyrivibrio proteoclasticus (strain ATCC 51982 / DSM 14932 / B316) (Clostridium proteoclasticum)
KYYTAICATYQAALDLCARVG

SEQ ID NO: 242 - protein, 13 aa, Elizabethkingia anophelis NUHP1
MAQLKGGIKSVEG

SEQ ID NO: 243 - protein, 14 aa, Clostridium sp. CAG:609
IIGAISGYINPVKC

SEQ ID NO: 244 - protein, 18 aa, groundwater metagenome
KTADQVAREAGAAGREIK

SEQ ID NO: 245 - protein, 15 aa, Streptococcus oralis subsp. tigurinus
STICTRMTGYGNGII

SEQ ID NO: 246 - protein, 15 aa, Streptococcus oralis subsp. tigurinus 2426
STICTRMTGYGNGII

SEQ ID NO: 247 - protein, 18 aa, Aquimarina atlantica
VLAAIGGLYKAGEAIGKG

SEQ ID NO: 248 - protein, 19 aa, Elizabethkingia anophelis NUHP1
MAQLKGGMQEIAKTCAAGS

SEQ ID NO: 249 - protein, 19 aa, Elizabethkingia anophelis NUHP1
MAQLKGGMQEIAKTCAAGS

SEQ ID NO: 250 - protein, 15 aa, Clostridium sp. KLE 1755
KVKQFFEQGAKSAME

SEQ ID NO: 251 - protein, 36 aa, Streptococcus salivarius (strain CCHSS3)
VATGVGNGLRLGIKTRTWQGAVAGAAGGAIVGGVGY

SEQ ID NO: 252 - protein, 36 aa, Streptococcus salivarius (strain 57.I); identical to SEQ ID NO: 251

SEQ ID NO: 253 - protein, 36 aa, Streptococcus salivarius (strain JIM8777); identical to SEQ ID NO: 251

SEQ ID NO: 254 - protein, 36 aa, Streptococcus thermophilus (strain ATCC BAA-250 / LMG 18311); identical to SEQ ID NO: 251

SEQ ID NO: 255 - protein, 12 aa, Chryseobacterium piperi
LKTIKGGGDQGV

SEQ ID NO: 256 - protein, 14 aa, Streptococcus dysgalactiae subsp. equisimilis RE378
IIGGLGGLASGLKF

SEQ ID NO: 257 - protein, 36 aa, Streptococcus intermedius ATCC 27335
IAGGAGNGLRLGIKTRTWQGVVAGAVGGAIIGGVGY

SEQ ID NO: 258 - protein, 36 aa, Streptococcus constellatus subsp. constellatus SK53; identical to SEQ ID NO: 257

SEQ ID NO: 259 - protein, 12 aa, Lactobacillus gasseri SV-16A-US
GGKAVNGFVNGN

SEQ ID NO: 260 - protein, 12 aa, Lactobacillus gasseri 224-1
GGKAVNGFVNGN

SEQ ID NO: 261 - protein, 13 aa, Elizabethkingia anophelis NUHP1
MAQLKGGIKNADG

SEQ ID NO: 262 - protein, 13 aa, Elizabethkingia anophelis NUHP1
MAQLKGGIKNADG

SEQ ID NO: 263 - protein, 12 aa, Chryseobacterium soli
RACTLISSGCAQ

SEQ ID NO: 264 - protein, 13 aa, Prevotella multisaccharivorax DSM 17128
QKGMSQVRGGVQE

SEQ ID NO: 265 - protein, 18 aa, Streptococcus oralis subsp. oralis
SIWKVGGAVVGGATALFA

SEQ ID NO: 266 - protein, 14 aa, Lactobacillus casei
GLGAIARSWAQGGF

SEQ ID NO: 267 - protein, 14 aa, Lactobacillus casei
GLGAIARSWAQGGF

SEQ ID NO: 268 - protein, 16 aa, Bacteroides oleiciplenus YIT 12058
CAKSGNAAGAAVMSAH

SEQ ID NO: 269 - protein, 14 aa, Polaromonas sp. CF318
VRALLGGIIATGSA

SEQ ID NO: 270 - protein, 14 aa, Streptococcus pyogenes serotype M3 (strain ATCC BAA-595 / MGAS315)
VIGGLGGLASGLKF

SEQ ID NO: 271 - protein, 14 aa, Streptococcus pyogenes serotype M1
VIGGLGGLASGLKF

SEQ ID NO: 272 - protein, 14 aa, Streptococcus dysgalactiae subsp. equisimilis (strain GGS_124)
VIGGLGGLASGLKF

SEQ ID NO: 273 - protein, 14 aa, Streptococcus pyogenes serotype M4 (strain MGAS10750)
VIGGLGGLASGLKF

SEQ ID NO: 274 - protein, 14 aa, Streptococcus pyogenes serotype M2 (strain MGAS10270)
VIGGLGGLASGLKF

SEQ ID NO: 275 - protein, 14 aa, Streptococcus pyogenes serotype M12 (strain MGAS9429)
VIGGLGGLASGLKF

SEQ ID NO: 276 - protein, 14 aa, Streptococcus pyogenes serotype M28 (strain MGAS6180)
VIGGLGGLASGLKF

SEQ ID NO: 277 - protein, 14 aa, Streptococcus pyogenes serotype M6 (strain ATCC BAA-946 / MGAS10394)
VIGGLGGLASGLKF

SEQ ID NO: 278 - protein, 16 aa, Lactobacillus gigeriorum DSM 23908 = CRBIP 24.85
DFWHKLMDSLCRNFNS

SEQ ID NO: 279 - protein, 18 aa, Alteromonas naphthalenivorans
RGGGWVGAAIGAISGGLG

SEQ ID NO: 280 - protein, 18 aa, Streptococcus pseudopneumoniae (strain IS7493)
SIWKIGAAVAGGAAALFA

SEQ ID NO: 281 - protein, 12 aa, Streptococcus sp. GMD4S
AAKIAGGITAAG

SEQ ID NO: 282 - protein, 12 aa, Streptococcus sp. GMD6S
AAKIAGGITAAG

SEQ ID NO: 283 - protein, 18 aa, Streptococcus infantis
SIWKVGAAVAGGATALFA

SEQ ID NO: 284 - protein, 13 aa, Mycobacterium ulcerans str. Harvey
AAGWKACSSIYGM

SEQ ID NO: 285 - protein, 13 aa, Vibrio cholerae
LVSGGIALGSRCG

SEQ ID NO: 286 - protein, 12 aa, Chryseobacterium sp. FH2
TGPKYCSTYIGC

SEQ ID NO: 287 - protein, 15 aa, Lactobacillus casei subsp. casei ATCC 393
GLGAIARSWAQGGFA

SEQ ID NO: 288 - protein, 17 aa, Streptococcus pneumoniae SP14-BS69
KAIAGGTALIGSGWAAG

SEQ ID NO: 289 - protein, 15 aa, Blautia sp. KLE 1732
TFGGGGDAAAAGVRK

SEQ ID NO: 290 - protein, 17 aa, Streptococcus pneumoniae SP6-BS73
KVIAGGTALIGSGLAAG

SEQ ID NO: 291 - protein, 17 aa, Streptococcus pneumoniae
KVIAGGTALIGSGLAAG

SEQ ID NO: 292 - protein, 16 aa, Enterococcus mundtii
NSAANLATGGAAGWKS

SEQ ID NO: 293 - protein, 18 aa, Bacillus thuringiensis (strain Al Hakam)
AGVAGFTKVAGAITAGAG

SEQ ID NO: 294 - protein, 18 aa, Bacillus cereus NVH0597-99
AGVAGFTKVAGAITAGAG

SEQ ID NO: 295 - protein, 18 aa, Bacillus cereus Rock1-15
AGVAGFTKVAGAITAGAG

SEQ ID NO: 296 - protein, 17 aa, Streptococcus pneumoniae serotype 4 (strain ATCC BAA-334 / TIGR4)
KAIAGGTALIGSGLAAG

SEQ ID NO: 297 - protein, 17 aa, Streptococcus pneumoniae serotype 2 (strain D39 / NCTC 7466)
KAIAGGTALIGSGLAAG

SEQ ID NO: 298 - protein, 17 aa, Streptococcus pneumoniae (strain Hungary19A-6)
KAIAGGTALIGSGLAAG

SEQ ID NO: 299 - protein, 17 aa, Streptococcus pneumoniae (strain CGSP14)
KAIAGGTALIGSGLAAG

SEQ ID NO: 300 - protein, 17 aa, Streptococcus pneumoniae (strain 70585)
KAIAGGTALIGSGLAAG

SEQ ID NO: 301 - protein, 17 aa, Streptococcus pneumoniae (strain JJA)
KAIAGGTALIGSGLAAG

SEQ ID NO: 302 - protein, 17 aa, Streptococcus pseudopneumoniae (strain IS7493)
KAIAGGTALIGSGLAAG

SEQ ID NO: 303 - protein, 17 aa, Streptococcus pneumoniae 2070335
KAIAGGTALIGSGLAAG

SEQ ID NO: 304 - protein, 17 aa, Streptococcus pneumoniae (strain ATCC BAA-255 / R6)
KAIAGGTALIGSGLAAG

SEQ ID NO: 305 - protein, 17 aa, Streptococcus mitis 11/5
KAIAGGTALIGSGLAAG

SEQ ID NO: 306 - protein, 17 aa, Tolypothrix bouteillei VB521301
VLKSMNAVASAFQFIAL

SEQ ID NO: 307 - protein, 13 aa, Caballeronia grimmiae
AGGRAVSAIVDGR

SEQ ID NO: 308 - protein, 18 aa, Clostridium perfringens C str. JGS1495
KAVALISAGVTTLAGAAA

SEQ ID NO: 309 - protein, 18 aa, Clostridium perfringens E str. JGS1987
KAVALISAGVTTLAGAAA

SEQ ID NO: 310 - protein, 18 aa, Clostridium perfringens B str. ATCC 3626
KAVALISAGVTTLAGAAA

SEQ ID NO: 311 - protein, 18 aa, Clostridium perfringens
KAVALISAGVTTLAGAAA

SEQ ID NO: 312 - protein, 30 aa, Bradyrhizobium sp. LTSPM299
LAGKALDALSHATDHTPTNVLNGMLGAIGR

SEQ ID NO: 313 - protein, 24 aa, Firmicutes bacterium CAG:534
MKEYAQSASDAKVKQFFEKGAKSA

SEQ ID NO: 314 - protein, 16 aa, Streptococcus equi subsp. zooepidemicus Sz4is
SHLPSIFEKFCNWIGM

SEQ ID NO: 315 - protein, 15 aa, Clostridium perfringens C str. JGS1495
TGAAIAKGAAAIGTA

SEQ ID NO: 316 - protein, 15 aa, Clostridium perfringens E str. JGS1987
TGAAIAKGAAAIGTA

SEQ ID NO: 317 - protein, 15 aa, Clostridium perfringens B str. ATCC 3626
TGAAIAKGAAAIGTA

SEQ ID NO: 318 - protein, 15 aa, Clostridium perfringens
TGAAIAKGAAAIGTA

SEQ ID NO: 319 - protein, 16 aa, Streptococcus vestibularis F0396
HTVYDFGRGFVDGFRG

SEQ ID NO: 320 - protein, 16 aa, Streptococcus vestibularis ATCC 49124
HTVYDFGRGFVDGFRG

SEQ ID NO: 321 - protein, 16 aa, Streptococcus sp. HSISS3
HTVYDFGRGFVDGFRG

SEQ ID NO: 322 - protein, 16 aa, Streptococcus sp. ACS2
HTVYDFGRGFVDGFRG

SEQ ID NO: 323 - protein, 17 aa, Streptococcus infantis SK1302
KAIAGGTALVGSGLTAG

SEQ ID NO: 324 - protein, 19 aa, [Eubacterium] rectale DSM 17629
FWTLVAAGFAGGIATGVSR

SEQ ID NO: 325 - protein, 17 aa, Streptococcus oralis subsp. oralis
KAIAGGTALVGSGLAAG

SEQ ID NO: 326 - protein, 17 aa, Streptococcus mitis
KAIAGGTALVGSGLAAG

SEQ ID NO: 327 - protein, 17 aa, Streptococcus infantis
KAIAGGTALVGSGLAAG

SEQ ID NO: 328 - protein, 27 aa, Burkholderia pseudomallei 576
TGGGGGASLGTGRGQRATIDKPIHIRR

SEQ ID NO: 329 - protein, 27 aa, Burkholderia pseudomallei Pakistan 9
TGGGGGASLGTGRGQRATIDKPIHIRR

SEQ ID NO: 330 - protein, 27 aa, Burkholderia pseudomallei 305
TGGGGCASLGTGRGQRATIDKPIHIRR

SEQ ID NO: 331 - protein, 39 aa, Nitrococcus mobilis Nb-231
QKAMKNIRGGARGTMGAGARARTSVRPLRTSLRRLFPNK

SEQ ID NO: 332 - protein, 40 aa, Polaromonas sp. CF318
ALLGGIIATGSARLSHARPQRGQTRDDRELDQRVRECGEW

SEQ ID NO: 333 - protein, 23 aa, Lactobacillus acidophilus (strain ATCC 700396 / NCK56 / N2 / NCFM)
GRGGGAQMRAIGSIPPWRPNWWK

SEQ ID NO: 334 - protein, 30 aa, Corynebacterium efficiens (strain DSM 44549 / YS-314 / AJ 12310 / JCM 11189 / NBRC 100395)
GGGGIARELATMLRPFGATSLAVTRTGAPH

SEQ ID NO: 335 - protein, 30 aa, Legionella fallonii LLAP-10
SGGNRVHEGFDRMRPRDPQTIIDTLRNRRT

SEQ ID NO: 336 - protein, 39 aa, Prevotella dentalis (strain ATCC 49559 / DSM 3688 / JCM 13448 / NCTC 12043 / ES 2772) (Mitsuokella dentalis)
RFLDRIMGGFRQNNISYRWLARWEKDIVTKEHISSHGIF

SEQ ID NO: 337 - protein, 22 aa, Legionella fallonii LLAP-10
DGVGKVVSGGSTVVDQFRRRSS

SEQ ID NO: 338 - protein, 38 aa, Legionella fallonii LLAP-10
SGGNRGTNAGQEIRESIERSAPAMRELLERFHNRNRSS

SEQ ID NO: 339 - protein, 19 aa, Desulfovibrio vulgaris (strain Hildenborough / ATCC 29579 / NCIMB 8303)
GGVLRRCWRDWLDSFFAVQ

SEQ ID NO: 340 - protein, 18 aa, Actinobaculum sp. oral taxon 183 str. F0552
VRGAVRTVAHLVTVEEVD

SEQ ID NO: 341 - protein, 31 aa, Lactobacillus paracasei subsp. paracasei Lpp123
YHIVRGALDTAGVDGRMQGRSKYGAKRPKKK

SEQ ID NO: 342 - protein, 18 aa, Burkholderia sp. (strain CCGE1003)
AAHRAIAKVAATRHKRRS

SEQ ID NO: 343 - protein, 19 aa, Advenella kashmirensis (strain DSM 17095 / LMG 22695 / WT001) (Tetrathiobacter kashmirensis)
RKAHALLDAGARYTWPPRS

SEQ ID NO: 344 - protein, 12 aa, Nitrosococcus halophilus (strain Nc4)
AARRAFASGRKA

SEQ ID NO: 345 - protein, 15 aa, Lactobacillus ruminis CAG:367
YNPFKNIFHRFSNGH

SEQ ID NO: 346 - protein, 33 aa, Bradyrhizobium diazoefficiens SEMIA 5080
DEADGVGSRLDAVETSSRYCAKRIGVIVRTIPV

SEQ ID NO: 347 - protein, 33 aa, Bradyrhizobium diazoefficiens
DEADGVGSRLDAVETSSRYCAKRIGVIARTIPV

SEQ ID NO: 348 - protein, 30 aa, Cardiobacterium hominis ATCC 15826
YHIVRGALDTAGVKDRKQGRSKYGAKRPKS

SEQ ID NO: 349 - protein, 24 aa, Synechococcus sp. (strain WH7803)
GVSAVLGLLGGGSLTALLLPDAKR

SEQ ID NO: 350 - protein, 35 aa, Microscilla marina ATCC 23134
KGGNCCENGGTPPPPPAAARSTTPLVANLKPRKKS

SEQ ID NO: 351 - protein, 41 aa, Burkholderia glathei PML1(12)
QALRSYAKPAGSTRIVNFPASQIGVTAPQPTAKATGRKARK

SEQ ID NO: 352 - protein, 13 aa, Lactobacillus hokkaidonensis JCM 18461
NGLKKFFKWVRKL

SEQ ID NO: 353 - protein, 18 aa, Lactobacillus brevis ATCC 14869 = DSM 20054
QQLVTLIRGGCAKIIARL

SEQ ID NO: 354 - protein, 17 aa, Streptomyces aurantiacus JA 4570
LPNLGRRMVGAWCFVVH

SEQ ID NO: 355 - protein, 11 aa, Lactobacillus crispatus JV-V01
TGAKIISHFLG

SEQ ID NO: 356 - protein, 25 aa, Bacteroides fragilis str. 3725 D9 ii
DLIDFMRQMISCVVSRRQRYKNSLK

SEQ ID NO: 357 - protein, 33 aa, Acidaminococcus intestini (strain RyC-MR95)
YHIIRGALDTAGVADRAQARSKYGAKRPKAAKK

SEQ ID NO: 358 - protein, 18 aa, Desulfosporosinus sp. OT
SGGGKFIGNLIKLARPLL

SEQ ID NO: 359 - protein, 19 aa, Lactobacillus plantarum
QMGATAIKQVKKLFKKWGW

SEQ ID NO: 360 - protein, 19 aa, Lactobacillus paraplantarum
QMGATAIKQVKKLFKKWGW

SEQ ID NO: 361 - protein, 19 aa, Lactobacillus plantarum subsp. plantarum ATCC 14917 = JCM 1149 = CGMCC 1.2437
QMGATAIKQVKKLFKKWGW

SEQ ID NO: 362 - protein, 19 aa, Lactobacillus plantarum AY01
QMGATAIKQVKKLFKKWGW

SEQ ID NO: 363 - protein, 19 aa, Lactobacillus plantarum subsp. plantarum
QMGATAIKQVKKLFKKWGW

SEQ ID NO: 364 - protein, 34 aa, Lactobacillus casei (strain ATCC 334)
IVSTIGGAVAGAAGLNPFTTVAGAAIGLSLPRLQ

SEQ ID NO: 365 - protein, 34 aa, Mycoplasma sp. CAG:956
TFFNALARSLSTISDIGRSLGTAIRMLFSKRVCK

SEQ ID NO: 366 - protein, 30 aa, Enterococcus sp. HSIEG1
YHIVRGALDTAGVNDRKQSRSKYGTKRPKA

SEQ ID NO: 367 - protein, 30 aa, Streptococcus oralis SK313
YHIVRGALDTAGVNDRKQGRSKYGTKRPKA

SEQ ID NO: 368 - protein, 30 aa, Streptococcus sp. HSISS3
YHIVRGALDTAGVADRKQSRSKYGAKRPKG

SEQ ID NO: 369 - protein, 30 aa, Burkholderia cenocepacia BC7
GGVRYAAKAARPSNCRSRCARGISGIGCPS

SEQ ID NO: 370 - protein, 12 aa, Lactobacillus equicursoris 66c
QLYKNLFKVFRK

SEQ ID NO: 371 - protein, 28 aa, Lactobacillus crispatus JV-V01
AGRNFGRTLRNVSQMLNSSMRPISIWNV

SEQ ID NO: 372 - protein, 25 aa, Lactobacillus plantarum
GAWKNFWSSLRKGFYDGKAGRAIRR

SEQ ID NO: 373 - protein, 13 aa, Lactobacillus plantarum
KTLTKFFKSLIKR

SEQ ID NO: 374 - protein, 24 aa, Lactobacillus kefiranofaciens (strain ZW3)
WTNMTNMIKKIKKNKKRAHFFGIF

SEQ ID NO: 375 - protein, 17 aa, Lactobacillus acidophilus (strain ATCC 700396 / NCK56 / N2 / NCFM)
VGRGLWENLSNIFKHHK

SEQ ID NO: 376 - protein, 31 aa, Lactobacillus rhamnosus; identical to SEQ ID NO: 341

SEQ ID NO: 377 - protein, 19 aa, Lactobacillus plantarum (strain ATCC BAA-793 / NCIMB 8826 / WCFS1)
QMGATAIKQVKKLFKKWGW

SEQ ID NO: 378 - protein, 14 aa, Lactobacillus sakei
SNFIHKIKQIFTHR

SEQ ID NO: 379 - protein, 35 aa, Commensalibacter intestini A911
NIIRTGLKNGDNWATIGKNIGLYFKNKYAGGNFAK

SEQ ID NO: 380 - protein, 25 aa, Lactobacillus paraplantarum
SAWKNFWSSLRKGFYDGEAGRAIRR

SEQ ID NO: 381 - protein, 31 aa, Lactobacillus hokkaidonensis JCM 18461
QGVGYAAGFLTSVSMRRAIRKGSASRYSRYY

SEQ ID NO: 382 - protein, 16 aa, Lactobacillus plantarum
SAVRGFIHGYSSSHQV

SEQ ID NO: 383 - protein, 14 aa, Lactobacillus sakei
GSFQSGYQKGWKNI

SEQ ID NO: 384 - protein, 27 aa, Rhodococcus rhodnii LMG 5362
GILGGGGEGIRSDPTRVAPRRFPRSPM

SEQ ID NO: 385 - protein, 15 aa, Bacillus thuringiensis IBL 200
KWGRELGQWIGSKIK

SEQ ID NO: 386 - protein, 25 aa, Leuconostoc carnosum
SWASKATSWLTGPQQPGSPLLKKHR

SEQ ID NO: 387 - protein, 33 aa, Dolosigranulum pigrum ATCC 51524
TVGGSYSSACKRVWNAKPGDITIALYCPLPKVK

SEQ ID NO: 388 - protein, 29 aa, Enterococcus pallens ATCC BAA-351
AVGKNVWEFGKGFVKGWNKAKSTKDLRFH

SEQ ID NO: 389 - protein, 15 aa, Bacillus cereus m1293
KWGKELGRWIGSKIK

SEQ ID NO: 390 - protein, 22 aa, Crocosphaera watsonii WH 0402
LESIQGGYGAIFIPHNQVMKQC

SEQ ID NO: 391 - protein, 30 aa, Lactobacillus salivarius
KKLQKIAGGATKKGGFKRWQCIFTFFGVCK

SEQ ID NO: 392 - protein, 30 aa, Lactobacillus salivarius (strain UCC118); identical to SEQ ID NO: 391

SEQ ID NO: 393 - protein, 30 aa, Lactobacillus salivarius SMXD51; identical to SEQ ID NO: 391

SEQ ID NO: 394 - protein, 30 aa, Lactobacillus salivarius ACS-116-V-Col5a; identical to SEQ ID NO: 391

SEQ ID NO: 395 - protein, 34 aa, Firmicutes bacterium CAG:582
QMINSFVKLVSTLLDLGRTMGSALRYATSKKKCN

SEQ ID NO: 396 - protein, 19 aa, Clostridium sp. CAG:1193
ELGRSFGSALRRLLKKKYC

SEQ ID NO: 397 - protein, 21 aa, Streptococcus equi subsp. equi
GGGWLEGLQKVFNVSKPKLLK

SEQ ID NO: 398 - protein, 31 aa, Enterococcus faecalis 02-MB-BW-10
GTGISSAYAAYTFSPKFHNPGWRRGPISGYK

SEQ ID NO: 399 - protein, 14 aa, Lactobacillus plantarum subsp. plantarum
HAFTKLLKALGGHH

SEQ ID NO: 400 - protein, 14 aa, Lactobacillus plantarum
HAFTKLLKALGGHH

SEQ ID NO: 401 - protein, 14 aa, Lactobacillus plantarum ZJ316
HAFTKLLKALGGHH

SEQ ID NO: 402 - protein, 21 aa, Streptococcus equi subsp. equi (strain 4047)
GGGWLEGLQKVFNVSKPKLLK

SEQ ID NO: 403 - protein, 21 aa, Streptococcus equi subsp. zooepidemicus (strain H70)
GGGWLEGLQKVFNVSKPKLLK

SEQ ID NO: 404 - protein, 15 aa, Bacillus thuringiensis (strain Al Hakam)
EWGKQLGKWIGSKIK

SEQ ID NO: 405 - protein, 25 aa, Lactobacillus plantarum EGD-AQ4
GAWKNFWSSLRKGFYDGEAGKPIRR

SEQ ID NO: 406 - protein, 25 aa, Lactobacillus plantarum
GAWKNFWSSLRKGFYDGEAGRAIRR

SEQ ID NO: 407 - protein, 25 aa, Lactobacillus plantarum (strain ATCC BAA-793 / NCIMB 8826 / WCFS1)
GAWKNFWSSLRKGFYDGEAGRAIRR

SEQ ID NO: 408 - protein, 16 aa, Streptococcus peroris ATCC 700780
RRITSFFANLFQKRKK

SEQ ID NO: 409 - protein, 25 aa, Lactobacillus sakei subsp. sakei (strain 23K)
LGKLVRAGVDIGIAIGSKGRYKPRH

SEQ ID NO: 410 - protein, 25 aa, Lactobacillus plantarum ZJ316
GAWKNFWSSLRKGFYDGEAGRAIRR

SEQ ID NO: 411 - protein, 42 aa, Dehalococcoides mccartyi (strain ATCC BAA-2266 / KCTC 15142 / 195) (Dehalococcoides ethenogenes (strain 195))
GIFGQADSVYRTKRGIEKTLFILTIVLVVLFLLVSLLMLKLS

SEQ ID NO: 412 - protein, 25 aa, Lactobacillus plantarum subsp. plantarum
GAWKNFWSSLRKGFYDGEAGRAIRR

SEQ ID NO: 413 - protein, 25 aa, Lactobacillus sakei
LGKLVRAGVDIGIAIGSKGRYKPRH

SEQ ID NO: 414 - protein, 18 aa, Blautia hydrogenotrophica DSM 10507
MEKVSGGASRYQHRRPVR

SEQ ID NO: 415 - protein, 14 aa, Lactobacillus buchneri (strain NRRL B-30929)
DAFGKGFKEGSHLA

SEQ ID NO: 416 - protein, 25 aa, Lactobacillus plantarum subsp. plantarum ATCC 14917 = JCM 1149 = CGMCC 1.2437
GAWKNFWSSLRKGFYDGEAGRAIRR

SEQ ID NO: 417 - protein, 39 aa, Weissella paramesenteroides ATCC 33313
VKSLLGLLGGIMGMRTNQSFIVQFLSLLLKQPGILTWIE

SEQ ID NO: 418 - protein, 18 aa, Blautia hydrogenotrophica CAG:147
MEKVSGGASRYQHRRPVR

SEQ ID NO: 419 - protein, 32 aa, Weissella hellenica
SGGKGFLSWASKATSWLVGPQQPGSPLLKKHR

SEQ ID NO: 420 - protein, 39 aa, Kordia algicida OT-1
GGAASAGANGHAAAASGQAKDTCQWSSCNNCHSLKCKVS

SEQ ID NO: 421 - protein, 25 aa, Microbacterium oleivorans
VAAVGTAGIAAGLTLIGVELRSPSR

SEQ ID NO: 422 - protein, 32 aa, Desulfovibrio piezophilus (strain DSM 21447 / JCM 15486 / C1TLV30)
EILKGGKTLVTPLFHRMRAGKCLVSGVSDFSK

SEQ ID NO: 423 - protein, 34 aa, Actinomyces sp. oral taxon 172 str. F0311
NVLNEVFGGVQTELRAGTRADLRVGNATRPARYG

SEQ ID NO: 424 - protein, 12 aa, Enterococcus avium (Streptococcus avium)
NLATGGAAGWKS

SEQ ID NO: 425 - protein, 15 aa, Bacillus thuringiensis serovar monterrey BGSC 4AJ1
KWAKSVGKWIASKIK

SEQ ID NO: 426 - protein, 15 aa, Bacillus cereus 03BB108
KWAKSVGKWIASKIK

SEQ ID NO: 427 - protein, 15 aa, Bacillus cereus 03BB108
KWAKSAGKWIASKIK

SEQ ID NO: 428 - protein, 39 aa, Staphylococcus pseudintermedius (strain HKU10-03)
ISGGGRIAESIGYGIGIGLACIGDSKCAARKLNKLSNKK

SEQ ID NO: 429 - protein, 32 aa, Lactobacillus amylovorus
KYGKKLGGVWGAVIGGVGGAAVCGLAGYVRKG

SEQ ID NO: 430 - protein, 41 aa, Enterococcus faecalis (Streptococcus faecalis)
GGESVFSKIGNAVGPAAYWILKGLGNMSDVNQADRINRKKH

SEQ ID NO: 431 - protein, 14 aa, Lactobacillus sakei
REYLNKITKWIKHH

SEQ ID NO: 432 - protein, 23 aa, Lactobacillus curvatus
DFLKGYLHGISAANKHKKGRLGY

SEQ ID NO: 433 - protein, 25 aa, Neisseria wadsworthii 9715
FENGREFFQAWLKFQQTNPYWQPFY

SEQ ID NO: 434 - protein, 14 aa, Lactobacillus sakei subsp. sakei (strain 23K)
REYLNKITKWIKHH

SEQ ID NO: 435 - protein, 21 aa, Firmicutes bacterium CAG:884
EIGQAFGSAIRRKISNAYCKI

SEQ ID NO: 436 - protein, 42 aa, Lactobacillus plantarum
AWKNFWSSLRKGFYDGEAGRANPSLINGLKLRRAYSGNQINY

SEQ ID NO: 437 - protein, 22 aa, Mycoplasma sp. CAG:611
DFGNSLGSSIRRIKGKKLCPIR

SEQ ID NO: 438 - protein, 30 aa, Lactobacillus salivarius GJ-24
IVQGAVAVFKSGYRHRNDIKAGFSAGFYGK

SEQ ID NO: 439 - protein, 29 aa, Sphaerotilus natans subsp. natans DSM 6575
FGGLLRHLFGFKSYSYHQPVKHEPPKSKH

SEQ ID NO: 440 - protein, 24 aa, Streptococcus equi subsp. zooepidemicus Sz4is
SHLPSIFEKFCNWIGMCDNKDMRI

SEQ ID NO: 441 - protein, 23 aa, Streptococcus equi subsp. zooepidemicus SzAM60
IGGGWLEGLQKVFNVSKPKLLKY

SEQ ID NO: 442 - protein, 13 aa, Leuconostoc citreum LBAE C10
VVSFGKGIVSAFG

SEQ ID NO: 443 - protein, 25 aa, Parcubacteria group bacterium GW2011_GWA2_39_18
GGIGEYYTSYAAILGGSNPLMPTNK

SEQ ID NO: 444 - protein, 23 aa, Bacillus akibai (strain ATCC 43226 / DSM 21942 / JCM 9157 / 1139)
GLATGFYGVYRAIEPFIGDEKKR

SEQ ID NO: 445 - protein, 16 aa, Streptococcus salivarius (strain CCHSS3)
FSSGYKFGTDLARRGR

SEQ ID NO: 446 - protein, 38 aa, Leuconostoc kimchii (strain IMSNU 11154 / KCTC 2386 / IH25)
KELAGIVGGGWGGIGIGVIKNWRGEVSAFKRGYRGENY

SEQ ID NO: 447 - protein, 12 aa, Lactobacillus sakei subsp. sakei LS25
NIGKKIKDIFGR

SEQ ID NO: 448 - protein, 24 aa, Clostridium sp. CAG:433
AVIAGVISFISGIFDGFTRPYKCR

SEQ ID NO: 449 - protein, 24 aa, Firmicutes bacterium CAG:582
LIGGLVTLITGMIDGYFRPLKCNK

SEQ ID NO: 450 - protein, 28 aa, Streptococcus equinus ATCC 33317
KELKQIVGGCGEITLMAVGGQKKRRIGL

SEQ ID NO: 451 - protein, 12 aa, Lactobacillus johnsonii (strain CNCM I-12250 / La1 / NCC 533)
TAATGGFGKIRK

SEQ ID NO: 452 - protein, 35 aa, Firmicutes bacterium CAG:460
SFFNSVARILRTAYDIGYSIGSSLRRLFSRNLCKI

SEQ ID NO: 453 - protein, 32 aa, Lactobacillus amylovorus; identical to SEQ ID NO: 429

SEQ ID NO: 454 - protein, 22 aa, Microscilla marina ATCC 23134
ADRVQDMWNSGNLQCQADNIVA

SEQ ID NO: 455 - protein, 13 aa, Enterococcus faecium CRL1879
SGFKKGWNGGRRK

SEQ ID NO: 456 - protein, 14 aa, Lactobacillus curvatus CRL 705
SNFIHKIKQIFTHR

SEQ ID NO: 457 - protein, 13 aa, Enterococcus faecium (Streptococcus faecium)
SGFKKGWNGGRRK

SEQ ID NO: 458 - protein, 13 aa, Enterococcus faecium TC 6
SGFKKGWNGGRRK

SEQ ID NO: 459 - protein, 28 aa, Klebsiella oxytoca
SYYRRGWDSVDTRDIVWQCQRYKEKHNV

SEQ ID NO: 460 - protein, 20 aa, Leuconostoc mesenteroides subsp. mesenteroides (strain ATCC 8293 / NCDO 523)
GIYQAGYAAGKDRAQAGLRR

SEQ ID NO: 461 - protein, 19 aa, Clostridium cellulovorans (strain ATCC 35296 / DSM 3052 / OCM 3 / 743B)
KALKKIIDAIVKRPPGQEL

SEQ ID NO: 462 - protein, 37 aa, Candidatus Woesebacteria bacterium GW2011_GWA2_33_28
LESLGSRARRVLKEISPEAKLELNKSLFDARSRFIER

SEQ ID NO: 463 - protein, 34 aa, Leuconostoc pseudomesenteroides
GGFIGRAIGDFVYFGAKGLRESGKLLNYYYKHKH

SEQ ID NO: 464 - protein, 37 aa, Lactobacillus gasseri
TGATRGVSWCRGFGPWGMTACALGGAAIGGYLGYKSN

SEQ ID NO: 465 - protein, 12 aa, Lactobacillus johnsonii N6.2
TAATGGFGKIRK

SEQ ID NO: 466 - protein, 37 aa, Lactobacillus gasseri
TGATRGVSWCRGFGPWGMTACGLGGAAIGGYLGYKSN

SEQ ID NO: 467 - protein, 12 aa, Lactobacillus johnsonii DPC 6026
TAATGGFGKIRK

SEQ ID NO: 468 - protein, 14 aa, Streptococcus infantarius subsp. infantarius ATCC BAA-102
QAAKAIGKAVGKLF

SEQ ID NO: 469 - protein, 14 aa, Streptococcus infantarius subsp. infantarius
QAAKAIGKAVGKLF

SEQ ID NO: 470 - protein, 35 aa, Chryseobacterium sp. StRB126
KGGNKAITPVREGDCTTTSVTNNCTTTSTTGATNL

SEQ ID NO: 471 - protein, 37 aa, Acholeplasma sp. CAG:878
ASFLNAISRGIETFLNLGRMIGSTIRRIGAKNLCPIS

SEQ ID NO: 472 - protein, 22 aa, Enterococcus faecalis (Streptococcus faecalis)
DFVTGLAKGIGKEGNKNKWKNV

SEQ ID NO: 473 - protein, 22 aa, Enterococcus faecalis (Streptococcus faecalis)
DFVAGLAKGIGKEGNKNKWKNV

SEQ ID NO: 474 - protein, 13 aa, Lactobacillus brevis
GLVGGAISCLNNK

SEQ ID NO: 475 - protein, 25 aa, Clostridium sp. CAG:524
SLLNELGQQLGSAIRRKRDGRKCAY

SEQ ID NO: 476 - protein, 29 aa, Mycoplasma sp. CAG:611
SIWAIIGALAGLIFGIGVFEGYTRPIKCR

SEQ ID NO: 477 - protein, 35 aa, Kordia algicida OT-1
FSKLQKLIGGVEKRTGESCFKICDTNIQNCTWGNA

SEQ ID NO: 478 - protein, 19 aa, Carnobacterium maltaromaticum (Carnobacterium piscicola)
SAGQKLGNMVGKIVPLPFG

SEQ ID NO: 479 - protein, 12 aa, Enterococcus mundtii CRL35
NLATGGAAGWKS

SEQ ID NO: 480 - protein, 12 aa, Lactobacillus gasseri
TAATGGFGKIRK

SEQ ID NO: 481 - protein, 21 aa, Carnobacterium maltaromaticum (Carnobacterium piscicola)
AGINSFVSGVASGAGSIGRRP

SEQ ID NO: 482 - protein, 27 aa, Enterococcus pallens ATCC BAA-351
LAGAAGGAVAGGCIKFGYNKTPKHGWN

SEQ ID NO: 483 - protein, 19 aa, Lactobacillus salivarius DSM 20555 = ATCC 11741
NFGKSYYGKCSFKFLGTCK

SEQ ID NO: 484 - protein, 13 aa, Lactobacillus brevis
GLVGGAISCLNNK

SEQ ID NO: 485 - protein, 13 aa, Lactobacillus brevis
GLVGGAISCLNNK

SEQ ID NO: 486 - protein, 12 aa, Streptococcus milleri
RGIIGIGKKLFG

SEQ ID NO: 487 - protein, 12 aa, Enterococcus mundtii
NLATGGAAGWKS

SEQ ID NO: 488 - protein, 27 aa, Lactobacillus johnsonii (strain CNCM I-12250 / La1 / NCC 533)
TGGARVNGFVGGKISKNIFYWTRNIWK

SEQ ID NO: 489 - protein, 27 aa, Lactobacillus johnsonii pf01
TGGARVNGFVGGKISKNIFYWTRNIWK

SEQ ID NO: 490 - protein, 27 aa, Lactobacillus johnsonii DPC 6026
TGGARVNGFVGGKISKNIFYWTRNIWK

SEQ ID NO: 491 - protein, 33 aa, Bacillus cereus BAG2O-3
AGFTKVAGAITAGAGVVGAGYVGGKWVGKKIFK

SEQ ID NO: 492 - protein, 33 aa, Bacillus cereus BAG5X2-1; identical to SEQ ID NO: 491

SEQ ID NO: 493 - protein, 28 aa, Leuconostoc mesenteroides subsp. mesenteroides
GWLSMASSALTGPQQPNSPWLAKIKNHK

SEQ ID NO: 494 - protein, 28 aa, Leuconostoc mesenteroides
GWLSMASSALTGPQQPNSPWLAKIKNHK

SEQ ID NO: 495 - protein, 12 aa, Enterococcus faecium (Streptococcus faecium)
NLATGGAAGWKS

SEQ ID NO: 496 - protein, 12 aa, Enterococcus mundtii
NLATGGAAGWKS

SEQ ID NO: 497 - protein, 12 aa, Enterococcus mundtii QU 25
NLATGGAAGWKS

SEQ ID NO: 498 - protein, 12 aa, Enterococcus mundtii
NLATGGAAGWKS

SEQ ID NO: 499 - protein, 12 aa, Listeria aquatica FSL S10-1188
NLATGGAAGWNK

SEQ ID NO: 500 - protein, 13 aa, Lactobacillus paraplantarum
KGFKKGMNHYNKK

SEQ ID NO: 501 - protein, 19 aa, Lactobacillus sakei
DIAKGIVSAMNSDNKKKHR

SEQ ID NO: 502 - protein, 33 aa, Bacillus cereus; identical to SEQ ID NO: 491

SEQ ID NO: 503 - protein, 33 aa, Bacillus cereus Rock1-15; identical to SEQ ID NO: 491

SEQ ID NO: 504 - protein, 13 aa, Lactobacillus plantarum AY01
KGFKKGMNHYNKK

SEQ ID NO: 505 - protein, 31 aa, Chryseobacterium sp. JM1
AAGSGYINTVSGECNSSGRSCWKALKDLLGF

SEQ ID NO: 506 - protein, 24 aa, Streptococcus sp. DORA_10
YGGNLWKDFDNLMLNKHRYSRFLN

SEQ ID NO: 507 - protein, 12 aa, Streptococcus intermedius F0395
RGIIGIGKKLFG

SEQ ID NO: 508 - protein, 32 aa, Streptococcus mitis
LQEIKGGFGAGVGIALFMAAYTIGKDLRKKFG

SEQ ID NO: 509 - protein, 36 aa, Lactobacillus acidophilus (strain ATCC 700396 / NCK56 / N2 / NCFM)
IGGSAKSYIRRLGPDGGYGGRESKLIAMADMIRRRI

SEQ ID NO: 510 - protein, 36 aa, Lactobacillus amylovorus
GGAGAVVGGLGGALLGGSLGVIAGSAVCVGYVASHR

SEQ ID NO: 511 - protein, 18 aa, Parcubacteria group bacterium GW2011_GWA2_56_7
SFGTEFWGSANSISKANG

SEQ ID NO: 512 - protein, 24 aa, Lactobacillus plantarum 16
KQWYRLGERVGRVAVFIGGGLLFK

SEQ ID NO: 513 - protein, 18 aa, Brachybacterium phenoliresistens
IRGMIRAVTHLVTVEEVD

SEQ ID NO: 514 - protein, 22 aa, Bacillus hemicellulosilyticus JCM 9152
GLCTGFYGVYKTVEPFLGEGRK

SEQ ID NO: 515 - protein, 12 aa, Chlamydia trachomatis
RGMIGIGKKLFG

SEQ ID NO: 516 - protein, 12 aa, Streptococcus anginosus subsp. whileyi CCUG 39159
RGMIGIGKKLFG

SEQ ID NO: 517 - protein, 19 aa, Enterococcus faecium (Streptococcus faecium)
IGNNAAANLTTGGKAGWKG

SEQ ID NO: 518 - protein, 13 aa, Enterococcus faecium EnGen0191
SGFKKGWNGGHRK

SEQ ID NO: 519 - protein, 29 aa, Lactobacillus paraplantarum
YLGRFLASATHYYGKTVTKGHMHSSTINN

SEQ ID NO: 520 - protein, 29 aa, Lactobacillus plantarum AY01
YLGRFLASATHYYGKTVTKGHMHSSTINN

SEQ ID NO: 521 - protein, 12 aa, Streptococcus anginosus T5
RGMIGIGKKLFG

SEQ ID NO: 522 - protein, 34 aa, Bacillus cereus VD078
RIVTALSAFFTSGFTVLLYIIAAIVLPTDKDIKR

SEQ ID NO: 523 - protein, 25 aa, Clostridium sp. CAG:557
ANFEQMLGAIDKMNKSGKLDYLKKK

SEQ ID NO: 524 - protein, 39 aa, Prevotella multisaccharivorax DSM 17128
STCGGGFINILTIRGAHDGVKGNTEIFLFGIRIYHGKNA

SEQ ID NO: 525 - protein, 16 aa, Streptococcus salivarius SK126
FSSGYKFGTDLARRGR

SEQ ID NO: 526 - protein, 35 aa, Clostridium cellulovorans (strain ATCC 35296 / DSM 3052 / OCM 3 / 743B)
KALKKAVSGLGKIIKIIIDLPKPPSPGPTNPGPTF

SEQ ID NO: 527 - protein, 14 aa, Chryseobacterium sp. JM1
GKSCWKILKDLIGL

SEQ ID NO: 528 - protein, 16 aa, Streptococcus salivarius (strain 57.I)
FSSGYKFGTDLARRGR

SEQ ID NO: 529 - protein, 40 aa, Lactobacillus casei M36
IVSTIGGAVAGAAGLNPFTTVAGAAIGLSLCLSTNYIHPA

SEQ ID NO: 530 - protein, 40 aa, Lactobacillus casei 21/1; identical to SEQ ID NO: 529

SEQ ID NO: 531 - protein, 40 aa, Lactobacillus casei 32G; identical to SEQ ID NO: 529

SEQ ID NO: 532 - protein, 40 aa, Lactobacillus casei A2-362; identical to SEQ ID NO: 529

SEQ ID NO: 533 - protein, 17 aa, Lactobacillus ruminis (strain ATCC 27782 / RF3)
RWGAAVGTGGKATIGHC

SEQ ID NO: 534 - protein, 17 aa, Lactobacillus ruminis
RWGAAVGTGGKATIGHC

SEQ ID NO: 535 - protein, 40 aa, Lactobacillus paracasei subsp. paracasei Lpp70; identical to SEQ ID NO: 529

SEQ ID NO: 536 - protein, 40 aa, Lactobacillus casei 5b; identical to SEQ ID NO: 529

SEQ ID NO: 537 - protein, 40 aa, Lactobacillus paracasei NRIC 0644; identical to SEQ ID NO: 529

SEQ ID NO: 538 - protein, 40 aa, Lactobacillus paracasei subsp. paracasei Lpp49; identical to SEQ ID NO: 529

SEQ ID NO: 539 - protein, 40 aa, Lactobacillus paracasei subsp. tolerans Lpl7; identical to SEQ ID NO: 529

SEQ ID NO: 540 - protein, 40 aa, Lactobacillus casei LOCK919; identical to SEQ ID NO: 529

SEQ ID NO: 541 - protein, 40 aa, Lactobacillus paracasei subsp. paracasei Lpp74; identical to SEQ ID NO: 529

SEQ ID NO: 542 - protein, 40 aa, Lactobacillus casei W56; identical to SEQ ID NO: 529

SEQ ID NO: 543 - protein, 40 aa, Lactobacillus paracasei subsp. paracasei Lpp123; identical to SEQ ID NO: 529

SEQ ID NO: 544 - protein, 40 aa, Lactobacillus paracasei NRIC 1981; identical to SEQ ID NO: 529

SEQ ID NO: 545 - protein, 20 aa, Leuconostoc pseudomesenteroides
LLGQAKDAVKQYKKDYKRWH

SEQ ID NO: 546 - protein, 33 aa, Chryseobacterium sp. CF314
GGLEDCINPATGGCRKISIGCAQPQCRPVIDPL

SEQ ID NO: 547 - protein, 28 aa, Chryseobacterium oranimense G311
DCIDPMTGACSKISIGCAQLQCRPGIEP

SEQ ID NO: 548 - protein, 37 aa, Chryseobacterium oranimense G311
LKAINGGAGSCAVGECKLRGVSHFIIIGPRGNDGYCC

SEQ ID NO: 549 - protein, 35 aa, Streptococcus mitis 29/42
LQEIKGGFGAGVGIALFMAGYTIGKDLRKKFGKSC

SEQ ID NO: 550 - protein, 33 aa, Bacillus cereus 03BB108; identical to SEQ ID NO: 491

SEQ ID NO: 551 - protein, 36 aa, Pedobacter sp. NL19
IAGGKAALGDVCVFKSSSCTIKPTEPTQPTQPTTTA

SEQ ID NO: 552 - protein, 27 aa, Carnobacterium divergens (Lactobacillus divergens)
GVVQAGVDFVSGVWAGIKQSAKDHPNA

SEQ ID NO: 553 - protein, 27 aa, Lactobacillus johnsonii N6.2
TGGARVNGFVNGNWNKGIFYWTRNIWK

SEQ ID NO: 554 - protein, 42 aa, Pediococcus pentosaceus
KYYGNGVHCGKKTCYVDWGQATASIGKIIVNGWTQHGPWAHR

SEQ ID NO: 555 - protein, 38 aa, Prochlorococcus marinus (strain MIT 9313)
QGIAGGAAYVKNKLERSVQRRAIRNPKIVEITGVLVGL

SEQ ID NO: 556 - protein, 33 aa, Bacillus cereus NVH0597-99; identical to SEQ ID NO: 491

SEQ ID NO: 557 - protein, 33 aa, Bacillus thuringiensis (strain Al Hakam); identical to SEQ ID NO: 491

SEQ ID NO: 558 - protein, 30 aa, Lactobacillus salivarius GJ-24
GGYNRLAGRIGHYTGKAALWGIAVAGLFLI

SEQ ID NO: 559 - protein, 34 aa, Pseudomonas sp. (strain M1)
NALGNGISGFVSGLLSGFVGVYLVLRKVRVPKPA

SEQ ID NO: 560 - protein, 15 aa, Providencia stuartii ATCC 25827
FNAIGNNGSTFNVTY

SEQ ID NO: 561 - protein, 15 aa, Providencia stuartii
FNAIGNNGSTFNVTY

SEQ ID NO: 562 - protein, 29 aa, Lactobacillus crispatus CTV-05
GGSKGWNKFWKSEGKYWRGFKEGLCKYAR

SEQ ID NO: 563 - protein, 29 aa, Lactobacillus crispatus FB077-07
GGSKGWNKFWKSEGKYWRGFKEGLCKYAR

SEQ ID NO: 564 - protein, 18 aa, Dermabacter hominis 1368
IRGMINAVRHLVTVEEVD

SEQ ID NO: 565 - protein, 18 aa, Dermabacter sp. HFH0086
IRGMINAVRHLVTVEEVD

SEQ ID NO: 566 - protein, 14 aa, Prevotella sp. F0091
ECVSGVIDWVRKRL

SEQ ID NO: 567 - protein, 35 aa, Lactobacillus salivarius
IGAAFGNPLTGCVANSAFSFSWQAFKNRPRPKKIA

SEQ ID NO: 568 - protein, 22 aa, Firmicutes bacterium CAG:822
ELGKSLGSSFRRITSGATCSLE

SEQ ID NO: 569 - protein, 41 aa, Leuconostoc mesenteroides subsp. mesenteroides (strain ATCC 8293 / NCDO 523)
DSWEGFGSGLHKTVNTVVYAGTTVARAHTRSHQRCFTGNKW

SEQ ID NO: 570 - protein, 21 aa, Enterococcus pallens ATCC BAA-351
KIGKTVGTIVRKGFEIWSIFK

SEQ ID NO: 571 - protein, 19 aa, Lactobacillus plantarum AY01
KLVTAFGSEFNDVTGKLGW

SEQ ID NO: 572 - protein, 27 aa, Streptococcus suis 6407
GGGDTVFDKVNHFFCDLINCRGKGRMN

SEQ ID NO: 573 - protein, 31 aa, Chryseobacterium indologenes NBRC 14944
MGGTAAGRCSEVGSKYADSIYVKRPGEELEG

SEQ ID NO: 574 - protein, 37 aa, Lactobacillus ultunensis DSM 16047
GGSDLGDLWTGARDWLWGFKNGFEGRARHHRSWRDRD

SEQ ID NO: 575 - protein, 32 aa, Mangrovibacter sp. MFB070
ASYYRKGWDSVDVRDIVWQCHRYKEKKNVQLN

SEQ ID NO: 576 - protein, 23 aa, Kordia algicida OT-1
SVLAALCNTINPLDCSMSAFCAY

SEQ ID NO: 577 - protein, 22 aa, Streptococcus equi subsp. zooepidemicus CY
GGGWLEGLQKVFNVSKPKLLEW

SEQ ID NO: 578 - protein, 20 aa, Lactobacillus acidophilus
NAWKSLWKGFWESLRYTDGF

SEQ ID NO: 579 - protein, 22 aa, Streptococcus equi subsp. zooepidemicus Sz16
GGGWLEGLQKVFNVSKPKLLEW

SEQ ID NO: 580 - protein, 21 aa, Bacillus thuringiensis serovar huazhongensis BGSC 4BD1
SVVAAIIGGAAGFVVGKYFKK

SEQ ID NO: 581 - protein, 30 aa, Bacillus thuringiensis (strain Al Hakam)
AGGAAIIDYGNDFVKGAKKGAKKAGNKSWL

SEQ ID NO: 582 - protein, 17 aa, Streptococcus sobrinus W1703
NVFKSVVDIARRGVIVY

SEQ ID NO: 583 - protein, 36 aa, Enterococcus faecium SD3B-2
KGGAKCGAAIAGGLFGIPKGPLAWAAGLANVYSKCN

SEQ ID NO: 584 - protein, 36 aa, Enterococcus faecium EnGen0191; identical to SEQ ID NO: 583

SEQ ID NO: 585 - protein, 36 aa, Enterococcus faecium CRL1879; identical to SEQ ID NO: 583

SEQ ID NO: 586 - protein, 36 aa, Enterococcus faecium (Streptococcus faecium); identical to SEQ ID NO: 583

SEQ ID NO: 587 - protein, 42 aa, Enterococcus faecium EnGen0263
TVAGAAGGGLAAGLGAIPGAFVGAHVGVIGGSAACIGGFLGN

SEQ ID NO: 588 - protein, 29 aa, Shimwellia blattae (Escherichia blattae)
ASYYRRGWDSVDIRDIVWQCQRYKEKHND

SEQ ID NO: 589 - protein, 19 aa, Elizabethkingia miricola (Chryseobacterium miricola)
DGIIGGIDKVIDGVIPRKP

SEQ ID NO: 590 - protein, 19 aa, Elizabethkingia sp. BM10
DGIIGGIDKVIDGIIPRKP

SEQ ID NO: 591 - protein, 29 aa, Shimwellia blattae (strain ATCC 29907 / DSM 4481 / JCM 1650 / NBRC 105725 / CDC 9005-74) (Escherichia blattae)
ASYYRRGWDSVDIRDIVWQCQRYKEKHND

SEQ ID NO: 592 - protein, 41 aa, Lactobacillus brevis
NAATAAASGAVKGILGGPTGALAGAIWGVSQCASNNLHGMH

SEQ ID NO: 593 - protein, 20 aa, Carnobacterium maltaromaticum (Carnobacterium piscicola)
IGNNAAANLTTGGAAGWNKG

SEQ ID NO: 594 - protein, 19 aa, Lactobacillus curvatus CRL 705
IGNNAVANLTTGGAAGWKS

SEQ ID NO: 595 - protein, 19 aa, Lactobacillus sakei
IGNNAVANLTTGGAAGWKS

SEQ ID NO: 596 - protein, 14 aa, Elizabethkingia meningoseptica 502
GNGGGGSYADIICV

SEQ ID NO: 597 - protein, 27 aa, Elizabethkingia sp. BM10
GKLRAWGGGCDSKCPDGMTPFCDVSRN

SEQ ID NO: 598 - protein, 41 aa, Streptococcus uberis (strain ATCC BAA-854 / 0140J)
ALQGLFGGFANSPTLEQLNGTKLPKPKSCSPYGTGGTSNAC

SEQ ID NO: 599 - protein, 32 aa, Bacillus cereus BDRD-ST26
WIGKVGKQYKKATDNYNKNRNKYCGNLSRKDC

SEQ ID NO: 600 - protein, 17 aa, Lactobacillus curvatus
SIIGGMISGWASGLAGM

SEQ ID NO: 601 - protein, 17 aa, Lactobacillus sakei
SIIGGMISGWASGLAGM

SEQ ID NO: 602 - protein, 14 aa, Carnobacterium maltaromaticum LMA28
VIGGWASSLAGMGH

SEQ ID NO: 603 - protein, 25 aa, Lactobacillus curvatus
IAGRVGAAYGHAQASANNHHSPING

SEQ ID NO: 604 - protein, 42 aa, Pediococcus pentosaceus (strain ATCC 25745 / 183-1w); identical to SEQ ID NO: 554

SEQ ID NO: 605 - protein, 39 aa, [Clostridium] straminisolvens JCM 21531
GTFGGSLPNFLTAFIGGRKLSKNQVEKLKKLIDEHKEVQ

SEQ ID NO: 606 - protein, 32 aa, Chryseobacterium soli
SIVTEGGGMGGTYGYVTSCALNDYTECLSRLS

SEQ ID NO: 607 - protein, 24 aa, Leuconostoc mesenteroides subsp. mesenteroides (strain ATCC 8293 / NCDO 523)
VAKDAWNHLDQIRSGWRKAGNSKW

SEQ ID NO: 608 - protein, 25 aa, Clostridium botulinum CFSAN001627
AEGIGNDLNDLYRGARDAWKATRRR

SEQ ID NO: 609 - protein, 33 aa, Chryseobacterium vrystaatense
CNSLCGPGGGVISNRPGVGDACNPDRSICCICY

SEQ ID NO: 610 - protein, 35 aa, Lactobacillus rhamnosus (strain ATCC 53103 / GG)
LAAYGGALATFLLADAWAHTDQIFKGFKKGWNGGR

SEQ ID NO: 611 - protein, 14 aa, Elizabethkingia sp. BM10
GNGGGGGYGDIICA

SEQ ID NO: 612 - protein, 42 aa, Mycoplasma sp. CAG:776
HELIKIYGGAINGTLINAFARLLDLAIEIGKMIGYSLQRLIK

SEQ ID NO: 613 - protein, 33 aa, Providencia rettgeri DSM 1131
NRLVQVVGGWLHSFALVTYFCMLLGFHSFTAYR

SEQ ID NO: 614 - protein, 31 aa, Chryseobacterium angstadtii
TLCGPAGGVISNKPGRGDACNPDRSICCFCH

SEQ ID NO: 615 - protein, 13 aa, Virgibacillus sp. SK37
LSRVKGGMSRIAG

SEQ ID NO: 616 - protein, 36 aa, Chryseobacterium vrystaatense
YSSISACASACGVTVNPSTTTPTTGPSTPVLTKPMQ

SEQ ID NO: 617 - protein, 27 aa, Chryseobacterium sp. JM1
GECRKYGRGCAEQQCQLIIIDPIERLF

SEQ ID NO: 618 - protein, 30 aa, Bacteroides oleiciplenus YIT 12058
RCRKVYHRLWGKSYGGWNNGMSCGYDGTKA

SEQ ID NO: 619 - protein, 39 aa, Chryseobacterium piperi
LKTIKGGGDQGVCYLPGGGYVIRDCSSRCPNGGYPACPA

SEQ ID NO: 620 - protein, 42 aa, Lactobacillus amylovorus
ATGAALGSAICGPGCGFVGAHWGAVGWTAVASFSGAFGKIRK

SEQ ID NO: 621 - protein, 13 aa, Enterococcus faecium EnGen0191
ALLGAGFGMWTGA

SEQ ID NO: 622 - protein, 12 aa, Providencia rustigianii DSM 4541
VKAFIEKCRKVY

SEQ ID NO: 623 - protein, 24 aa, Lactobacillus paracasei subsp. tolerans Lpl7
GAVDTVFGIIGNGWGSAGASGRQH

SEQ ID NO: 624 - protein, 24 aa, Lactobacillus paracasei subsp. paracasei CNCM I-4270
GAVDTVFGIIGNGWGSAGASGRQH

SEQ ID NO: 625 - protein, 20 aa, Lactobacillus casei
NAWKSLWKGFWESLRYTDGF

SEQ ID NO: 626 - protein, 20 aa, Lactobacillus paracasei subsp. paracasei
NAWKSLWKGFWESLRYTDGF

SEQ ID NO: 627 - protein, 22 aa, Streptococcus pseudopneumoniae 22725
RFFGGIYNAGRSFGRNVYNAFY

SEQ ID NO: 628 - protein, 12 aa, Streptococcus sp. SK140
RLPHIIKKLFSK

SEQ ID NO: 629 - protein, 22 aa, Streptococcus pseudopneumoniae (strain IS7493)
RFFGGIYNAGRSFGRNVYNAFY

SEQ ID NO: 630 - protein, 29 aa, Staphylococcus epidermidis
GEKIGKLLREVREAKNPARDLTEIFSLKG

SEQ ID NO: 631 - protein, 29 aa, Chryseobacterium soli
GSVFHTGTTVGTDTGVSQNVIEDVKDSYN

SEQ ID NO: 632 - protein, 42 aa, Staphylococcus aureus
AIGSTVAGAGLGGAICGPACAVVGAHYGPIIWAGVSGATGAF

SEQ ID NO: 633 - protein, 20 aa, Carnobacterium maltaromaticum (Carnobacterium piscicola)
IGNNAAANLTTGGAAGWNKG

SEQ ID NO: 634 - protein, 20 aa, Streptococcus anginosus subsp. whileyi CCUG 39159
AGAVGGAIIGGVGYGATCWW

SEQ ID NO: 635 - protein, 21 aa, Clostridium sp. CAG:433
DMGRALGSSIRRLVNNNMCDF

SEQ ID NO: 636 - protein, 20 aa, Streptococcus sp. HSISS3
ATVNTVVNGWMRYGPWIPRP

SEQ ID NO: 637 - protein, 20 aa, Streptococcus salivarius
ATVNTVVNGWMRYGPWIPRP

SEQ ID NO: 638 - protein, 15 aa, Providencia sneebia DSM 19967
YKNVKAFIEKCRSSY

SEQ ID NO: 639 - protein, 33 aa, blood disease bacterium R229
IAERAADLIRRGGRPVLNVVTDAPAQSVPAGVR

SEQ ID NO: 640 - protein, 33 aa, Ralstonia solanacearum PSI07; identical to SEQ ID NO: 639

SEQ ID NO: 641 - protein, 42 aa, Brochothrix campestris
TVAGAAGGGLAAGLGAIPGAFVGAHFGVIGGSAACIGGLLGN

SEQ ID NO: 642 - protein, 40 aa, Lactobacillus johnsonii N6.2
SAASGAGTGIKACKSFGPWGMAICGVGGAAIGGYFGYTHN

SEQ ID NO: 643 - protein, 42 aa, Brochothrix campestris FSL F6-1037; identical to SEQ ID NO: 641

SEQ ID NO: 644 - protein, 42 aa, Streptococcus salivarius (strain 57.I)
GVGAVGGAIKGGIQTGTWQGAALKGIGYGIKGGITYGLTCRY

SEQ ID NO: 645 - protein, 27 aa, Streptococcus agalactiae (strain ATCC 13813 / DSM 2134 / JCM 5671 / NCIMB 701348 / NCTC 8181)
GGGDTVFDKVNHFFCDLINCRGKGRMN

SEQ ID NO: 646 - protein, 40 aa, Lactobacillus johnsonii DPC 6026; identical to SEQ ID NO: 642

SEQ ID NO: 647 - protein, 42 aa, Streptococcus salivarius (strain CCHSS3)
GVGAVGGAVKGGIQTGTWQGAALKGIGYGIKGGITYGLTCRY

SEQ ID NO: 648 - protein, 14 aa, Echinicola vietnamensis (strain DSM 17526 / LMG 23754 / KMM 6221)
SCGNKVKNGLRDYN

SEQ ID NO: 649 - protein, 20 aa, Streptococcus vestibularis F0396
ATVNTVVNGWMKYGPWIPRR

SEQ ID NO: 650 - protein, 31 aa, Blastomonas sp. CACIA14H2
GLLGGIFGLLRKPAAYCKPAPVCAPKPKHGC

SEQ ID NO: 651 - protein, 18 aa, Leuconostoc mesenteroides subsp. mesenteroides
EAASAGIHRLANGGNGFW

SEQ ID NO: 652 - protein, 15 aa, Anaerococcus hydrogenalis DSM 7454
AGNLIRGFKDVWKNN

SEQ ID NO: 653 - protein, 42 aa, Lactobacillus plantarum
  misc_feature (13)..(13): Xaa can be any naturally occurring amino acid
GNAATAAASGAVXGILGGPTGALAGAIWGVSQCASNNLHGMH

SEQ ID NO: 654 - protein, 40 aa, Streptococcus uberis (strain ATCC BAA-854 / 0140J)
GGLGGLQTGIKYCKVPHPVLKGVCIVGFTTAGAYLAYKAN

SEQ ID NO: 655 - protein, 24 aa, Klebsiella pneumoniae ISC21
GAGRSGCAPGTQLAGDGIQRLAGG

SEQ ID NO: 656 - protein, 27 aa, Lactobacillus crispatus (strain ST1)
SAFGAAWGLAKASVLYCGLGPQPQKVY

SEQ ID NO: 657 - protein, 23 aa, Bacillus sp. CAG:988
DAGRSVGSGIRRATSDSLCPTDL

SEQ ID NO: 658 - protein, 32 aa, Elizabethkingia sp. BM10
GWWQAGLAIAGAVIYLYNEGGDFIKGYKEGRK

SEQ ID NO: 659 - protein, 14 aa, Streptococcus agalactiae (strain ATCC 13813 / DSM 2134 / JCM 5671 / NCIMB 701348 / NCTC 8181)
GSACAYMRRVCKKN

SEQ ID NO: 660 - protein, 31 aa, Chryseobacterium sp. JM1
TLCGPGGGVISNTPGVGDACSPDRKVCCICY

SEQ ID NO: 661 - protein, 14 aa, Amphibacillus xylanus (strain ATCC 51415 / DSM 6626 / JCM 7361 / LMG 17667 / NBRC 15112 / Ep01)
IWTPAKNLYNKIFR

SEQ ID NO: 662 - protein, 38 aa, Paenibacillus sp. VT-400
VAVGDAAFDNWFVLAHFLSPRLLLSPRHKPDIPRQNAR

SEQ ID NO: 663 - protein, 38 aa, Elizabethkingia anophelis NUHP1
MAQLRGGVRQLDESCAAFSCNTSCKSGSCNSKTTEEIS

SEQ ID NO: 664 - protein, 32 aa, Alteromonas macleodii (strain Balearic Sea AD45)
GGKQGIDNYIENSIASARSSINYWNRRILGKS

SEQ ID NO: 665 - protein, 33 aa, Pandoraea vervacti
SGGAGYVKPGGVFSLTNPSATLPRKSNQYYQAS

SEQ ID NO: 666 - protein, 33 aa, Elizabethkingia anophelis NUHP1
GGMQEIAKTCAAGSCLNSCSSGSCNTKAVEEIS

SEQ ID NO: 667 - protein, 33 aa, Elizabethkingia anophelis NUHP1
GGMQEIAKTCAAGSCLNSCNSGSCNTKAVEEIS

SEQ ID NO: 668 - protein, 17 aa, Enterococcus pallens ATCC BAA-351
NAAANWATGGAAGWNKG

SEQ ID NO: 669 - protein, 37 aa, Lactobacillus plantarum
KYYGNGVTCGKHSCSVNWGQAFSCSVSHLANFGHGKC

SEQ ID NO: 670 - protein, 17 aa, Streptococcus sp. HSISB1
NLVSGLYDGWKSKHKKK

SEQ ID NO: 671 - protein, 29 aa, groundwater metagenome
QVAREAGAAGREIKDEFMKGREEGKKEGK

SEQ ID NO: 672 - protein, 38 aa, Elizabethkingia anophelis NUHP1
MAQLKGGIKSVEGSCGAGSCAHSCNKDSCNTKAIEEIS

SEQ ID NO: 673 - protein, 38 aa, Elizabethkingia anophelis NUHP1
MAQLKGGIKNADGSCGVASCGSSCKNDSCNTKAVEEVS

SEQ ID NO: 674 - protein, 38 aa, Elizabethkingia anophelis NUHP1
MAQLKGGIKNADGSCGVASCGSSCNKDSCNTKTVEELS

SEQ ID NO: 675 - protein, 18 aa, Chryseobacterium sp. FH2
TGPKYCSTYIGCPQVITC

SEQ ID NO: 676 - protein, 19 aa, Clostridium sp. CAG:609
IIGAISGYINPVKCNGSSK

SEQ ID NO: 677 - protein, 33 aa, Bacteroides vulgatus str. 3975 RP4
SYCTDLITNYNNNHTKWSKEVQEIALDMMQAHC

SEQ ID NO: 678 - protein, 32 aa, Clostridium sp. CAG:302
ITTIIGTIITFIVGTLKGYSNPEKCNVLGGKR

SEQ ID NO: 679 - protein, 27 aa, Spirosoma linguale (strain ATCC 33905 / DSM 74 / LMG 10896)
LSTLVGGGSTCAGLTCSWCTSTMSSRS

SEQ ID NO: 680 - protein, 36 aa, Chryseobacterium taiwanense
CLQLITQFVEALPEDYCAYPENAAHIACQCKRLYGL

SEQ ID NO: 681 - protein, 31 aa, Enterobacter sp. DC4
GGNGGNGGRGGNGGNGGNGGNCGGGNNGGRR

SEQ ID NO: 682 - protein, 18 aa, Lactococcus lactis
GFGKGAIKEGNKDKWKNI

SEQ ID NO: 683 - protein, 27 aa, Lactobacillus crispatus 125-2-CHN
LAQMWDSVGRIMYTGWQKDGPFAHPLV

SEQ ID NO: 684 - protein, 27 aa, Lactobacillus crispatus CTV-05
LAQMWDSVGRIMYTGWQKDGPFAHPLV

SEQ ID NO: 685 - protein, 27 aa, Lactobacillus crispatus MV-3A-US
LAQMWDSVGRIMYTGWQKDGPFAHPLV

SEQ ID NO: 686 - protein, 29 aa, Clostridium sp. CAG:914
KAVTALYDLGKGFGSALRRAISGNYCPVR

SEQ ID NO: 687 - protein, 27 aa, Lactobacillus crispatus FB077-07
LAQMWDSVGRIMYTGWQKDGPFAHPLV

SEQ ID NO: 688 - protein, 37 aa, Clostridium sp. CAG:451
GTILNQLNKLISILVDSGKSLGSSIRRISEDKICPLD

SEQ ID NO: 689 - protein, 34 aa, Spirosoma linguale (strain ATCC 33905 / DSM 74 / LMG 10896)
QEMSTLFGGGSTCSSFTCTSCAATLSSKSIQQFD

SEQ ID NO: 690 - protein, 22 aa, Bacillus cereus BAG2O-3
GAGAGLWDAYEESQAKKKKKKK

SEQ ID NO: 691 - protein, 22 aa, Bacillus cereus BAG5X2-1
GAGAGLWDAYEESQAKKKKKKK

SEQ ID NO: 692 - protein, 22 aa, Bacillus cereus Rock1-15
GAGAGMWDAYEESQAKKKKKKK

SEQ ID NO: 693 - protein, 42 aa, Elizabethkingia sp. BM10
VAGGLRSCMDGCGPGECCSKGVCRSGPNTGPRPYLCDPPILD

SEQ ID NO: 694 - protein, 42 aa, Elizabethkingia anophelis NUHP1
VSGGLRSCMDGCGPGECCSKGVCRSGPNTGPRPYLCDPPIIE

SEQ ID NO: 695 - protein, 42 aa, Elizabethkingia meningoseptica 502; identical to SEQ ID NO: 694

SEQ ID NO: 696 - protein, 37 aa, Paenibacillus sp. FSL R7-269
AAAAFFSFGTAILLYIIGSLIIPQESYGGFDDSFNNY

SEQ ID NO: 697 - protein, 26 aa, Elizabethkingia sp. BM10
GNCATEFCTQISFSCGQRDCWPTPIE

SEQ ID NO: 698 - protein, 31 aa, Chryseobacterium sp. StRB126
TLCGEAGGVVSNHPGIGDMCTPDRSLCCYCR

SEQ ID NO: 699 - protein, 31 aa, Chryseobacterium sp. JM1
CANGVCRPIAGAGPNTYYCTPPTMIDFTPQG

SEQ ID NO: 700 - protein, 34 aa, Serratia fonticola AU-AP2C
GTSAVTVCRRVATCQGKFGEFLTREPADLARCGA

SEQ ID NO: 701 - protein, 34 aa, Serratia fonticola
GTSAVTVCRRVATCQGKFGDFLTREPADLARCGA

SEQ ID NO: 702 - protein, 13 aa, Lactobacillus sakei
GVNHLANGGHGVC

SEQ ID NO: 703 - protein, 31 aa, Elizabethkingia meningoseptica FMS-007
KKGLRQITGGMECVCGRPCPDPNQPPPKECD

SEQ ID NO: 704 - protein, 31 aa, Elizabethkingia anophelis NUHP1
KKGLRQITGGMECMCGRPCPDPNQPPPKECD

SEQ ID NO: 705 - protein, 21 aa, Elizabethkingia sp. BM10
GGCRSIAGAGPKTYLCYAPMY

SEQ ID NO: 706 - protein, 40 aa, Lactobacillus johnsonii (strain CNCM I-12250 / La1 / NCC 533); identical to SEQ ID NO: 642

SEQ ID NO: 707 - protein, 18 aa, Leuconostoc gelidum
EAFSAGVHRLANGGNGFW

SEQ ID NO: 708 - protein, 18 aa, Leuconostoc carnosum
EAFSAGVHRLANGGNGFW

SEQ ID NO: 709 - protein, 18 aa, Leuconostoc mesenteroides
EAASAGIHRLANGGNGFW

SEQ ID NO: 710 - protein, 32 aa, Flavobacterium johnsoniae (strain ATCC 17061 / DSM 2064 / UW101) (Cytophaga johnsonae)
SICASGYGLVATGCQGTSYPMLDGYTCVLTCL

SEQ ID NO: 711 - protein, 22 aa, Chryseobacterium soli
TGPEYCSTYFGCPQVYTCGTNI

SEQ ID NO: 712 - protein, 29 aa, Brochothrix campestris
AVIGGALGGLGGAGGGCITGAIGSIWDQW

SEQ ID NO: 713 - protein, 29 aa, Brochothrix campestris FSL F6-1037
AVIGGALGGLGGAGGGCITGAIGSIWDQW

SEQ ID NO: 714 - protein, 15 aa, Carnobacterium maltaromaticum (Carnobacterium piscicola)
GWLAGAAGVINSCMK

SEQ ID NO: 715 - protein, 27 aa, Lactobacillus sakei
DWGTAIGNIGNNAAANWATGGNAGWNK

SEQ ID NO: 716 - protein, 41 aa, Enterococcus faecium T110
SGATAGVKLCSAGGPYAIAACGVGGALLGAGFGMWTGAVNN

SEQ ID NO: 717 - protein, 38 aa, Enterococcus faecium CRL1879
SGATAGVKLCSAGGPYAIAACGVGGALLGAGFSMWTGA

SEQ ID NO: 718 - protein, 20 aa, Streptococcus constellatus
AGAVGGAIIGGVGYGATCWW

SEQ ID NO: 719 - protein, 38 aa, Enterococcus faecium (Streptococcus faecium)
SGATAGVKLCSAGGPYAIAACGVGGALLGAGFGMWTGA

SEQ ID NO: 720 - protein, 38 aa, Peptoclostridium difficile Y384; identical to SEQ ID NO: 717

SEQ ID NO: 721 - protein, 20 aa, Streptococcus intermedius BA1
AGAVGGAIIGGVGYGATCWG

SEQ ID NO: 722 - protein, 38 aa, Enterococcus faecium (Streptococcus faecium); identical to SEQ ID NO: 717

SEQ ID NO: 723 - protein, 38 aa, Enterococcus faecium R496; identical to SEQ ID NO: 717

SEQ ID NO: 724 - protein, 41 aa, Enterococcus faecium 505; identical to SEQ ID NO: 716

SEQ ID NO: 725 - protein, 17 aa, Lactobacillus curvatus
SIIGGMISGWASGLAGM

SEQ ID NO: 726 - protein, 27 aa, Capnocytophaga cynodegmi
GFSGIGTLISGFVGLAGFGMSLRCRVL

SEQ ID NO: 727 - protein, 38 aa, Enterococcus faecium 1,231,501; identical to SEQ ID NO: 719

SEQ ID NO: 728 - protein, 35 aa, Clostridium sp. CAG:609
TFLSSFARMISSIYDVGNNLGSSIRRIVEKRMCSY

SEQ ID NO: 729 - protein, 38 aa, Enterococcus faecium EnGen0263; identical to SEQ ID NO: 719

SEQ ID NO: 730 - protein, 29 aa, Echinicola vietnamensis (strain DSM 17526 / LMG 23754 / KMM 6221)
AFLAAVGQQWAATLGITAAAAAGGCFDYW

SEQ ID NO: 731 - protein, 40 aa, Streptococcus intermedius B196
SGIAGGAGNGLRLGIKTRTWQGVVAGAIIGGVGYGATCWW

SEQ ID NO: 732 - protein, 20 aa, Streptococcus constellatus subsp. constellatus SK53
AGAVGGAIIGGVGYGATCWW

SEQ ID NO: 733 - protein, 20 aa, Streptococcus intermedius ATCC 27335
AGAVGGAIIGGVGYGATCWW

SEQ ID NO: 734 - protein, 11 aa, Capnocytophaga canimorsus
TAGAAYSGCFD

SEQ ID NO: 735 - protein, 14 aa, Carnobacterium maltaromaticum (Carnobacterium piscicola)
VIGGWASSLAGMGH

SEQ ID NO: 736 - protein, 26 aa, Clostridium sp. CAG:448
MKTCKGCGASILSTENYCEKCKKKQG

SEQ ID NO: 737 - protein, 42 aa, Streptococcus sp. SR4
GVGAVGGAIKGGIQTGTWQGAALKGIGYGIKDGITYGLICRY

SEQ ID NO: 738 - protein, 42 aa, Streptococcus sp. ACS2; identical to SEQ ID NO: 737

SEQ ID NO: 739 - protein, 42 aa, Streptococcus salivarius SK126; identical to SEQ ID NO: 737

SEQ ID NO: 740 - protein, 42 aa, Enterococcus faecium (Streptococcus faecium); identical to SEQ ID NO: 641

SEQ ID NO: 741 - protein, 41 aa, Chryseobacterium vrystaatense
GGYGDMCNMGNNDSCAQYGLECGLYMGHDHSVGNWYALRCM

SEQ ID NO: 742 - protein, 42 aa, Streptococcus salivarius; identical to SEQ ID NO: 737

SEQ ID NO: 743 - protein, 42 aa, Streptococcus sp. HSISS1; identical to SEQ ID NO: 737

SEQ ID NO: 744 - protein, 42 aa, Streptococcus salivarius (strain JIM8777); identical to SEQ ID NO: 737

SEQ ID NO: 745 - protein, 42 aa, Streptococcus salivarius CAG:79; identical to SEQ ID NO: 737

SEQ ID NO: 746 - protein, 28 aa, Kordia algicida OT-1
VNEIKGGLTAMMCNTVPEWDGGIGCHLW

SEQ ID NO: 747 - protein, 37 aa, Capnocytophaga ochracea (strain ATCC 27872 / DSM 7271 / JCM 12966 / NCTC 12371 / VPI 2845) (Bacteroides ochrac eus)
LQGIEGGCGHLNIMNIIERDGCRPKGHRWKWFWQDEY

SEQ ID NO: 748 - protein, 39 aa, Bacillus thuringiensis (strain Al Hakam)
DAWEKIGEWVGEIGSIWGNSNKKSWEICQKKGIKNRRDC

SEQ ID NO: 749 - protein, 42 aa, Streptococcus sp. HSISS3; identical to SEQ ID NO: 647

SEQ ID NO: 750 - protein, 37 aa, Elizabethkingia meningoseptica FMS-007
NPGETIGDGLSRECGEECGPDNGCGDGYPKCDGVCKK

SEQ ID NO: 751 - protein, 35 aa, Streptococcus sobrinus W1703
IKGGGDEGYNFWYGIGKWARQQYRGFCNWSNWCKG

SEQ ID NO: 752 - protein, 21 aa, Streptococcus pneumoniae
SFIASYLGSAQTRCGKDNKKK

SEQ ID NO: 753 - protein, 21 aa, Streptococcus sp. BS29a
SFIASYLGSAQTRCGKDNKKK

SEQ ID NO: 754 - protein, 21 aa, Streptococcus pneumoniae (strain JJA)
SFIASYLGSAQTRCGKDNKKK

SEQ ID NO: 755 - protein, 21 aa, Streptococcus pneumoniae (strain ATCC BAA-255 / R6)
SFIASYLGSAQTRCGKDNKKK

SEQ ID NO: 756 - protein, 21 aa, Streptococcus pneumoniae serotype 4 (strain ATCC BAA-334 / TIGR4)
SFIASYLGSAQTRCGKDNKKK

SEQ ID NO: 757 - protein, 21 aa, Streptococcus pneumoniae serotype 2 (strain D39 / NCTC 7466)
SFIASYLGSAQTRCGKDNKKK

SEQ ID NO: 758 - protein, 22 aa, Sinorhizobium americanum CCGM7
VDIVGAFVDRLCIERISRSSFS

SEQ ID NO: 759 - protein, 41 aa, Chryseobacterium gleum ATCC 35910
GIAGGIAANCPSMFQSCEEWCSWTPWQKSHCILSEPCTECF

SEQ ID NO: 760 - protein, 35 aa, Chryseobacterium indologenes NBRC 14944
TYVQSYMNELRAEGHSDVEAIAILRGKLLACGIHP

SEQ ID NO: 761 - protein, 28 aa, Elizabethkingia meningoseptica (Chryseobacterium meningosepticum)
GNCATEFCTQISFSCGQRDCWPTPIEIE

SEQ ID NO: 762 - protein, 28 aa, Elizabethkingia anophelis
GNCATEFCTQISFSCGQRDCWPTPIEIE

SEQ ID NO: 763 - protein, 28 aa, Elizabethkingia anophelis R26
GNCATEFCTQISFSCGQRDCWPTPIEIE

SEQ ID NO: 764 - protein, 28 aa, Elizabethkingia anophelis NUHP1
GNCATEFCTQISFSCGQRDCWPTPIEIE

SEQ ID NO: 765 - protein, 23 aa, Chryseobacterium piperi
AAFEALPQCCKSKVLVSIDCFPQ

SEQ ID NO: 766 - protein, 41 aa, Bacteroides fragilis (strain ATCC 25285 / DSM 2151 / JCM 11019 / NCTC 9343)
QVANTYAGKCSCMCEGSGVYSYYNTINSEAHLYKSNGTIVK

SEQ ID NO: 767 - protein, 41 aa, Bacteroides sp. 2_1_16; identical to SEQ ID NO: 766

SEQ ID NO: 768 - protein, 18 aa, Chryseobacterium soli
RACTLISSGCAQKICRPQ

SEQ ID NO: 769 - protein, 21 aa, Elizabethkingia miricola (Chryseobacterium miricola)
WCEKLSACVQSGQYAKNCKSL

SEQ ID NO: 770 - protein, 21 aa, Elizabethkingia anophelis NUHP1
GGCRSLAGAGPKTYLCYAPMY

SEQ ID NO: 771 - protein, 21 aa, Elizabethkingia meningoseptica 502
GGCRSIAGAGPKTYLCYAPMY

SEQ ID NO: 772 - protein, 19 aa, Citrobacter sp. KTE151
QWVELVEKVAAAGIGVKGE

SEQ ID NO: 773 - protein, 36 aa, Xylella fastidiosa 32
GAFAGAGGLIGAAAGAGWMAGTFIHNRLVSAYPRIF

SEQ ID NO: 774 - protein, 41 aa, Flavobacterium sp. 316
TAGGKVFNPGGGDGPGEDGCGFNTCRNQWGRCSWAACDRGY

SEQ ID NO: 775 - protein, 27 aa, Bacteroides oleiciplenus YIT 12058
CAKSGNAAGAAVMSAHGAAGSMTVVCN

SEQ ID NO: 776 - protein, 27 aa, Bacteroides intestinalis CAG:564
ASAAQTAVSKVHMNQDVIRDEVAVVCY

SEQ ID NO: 777 - protein, 27 aa, Bacteroides intestinalis DSM 17393
ASAAQTAVSKVHMNQDVIRDEVAVVCY

SEQ ID NO: 778 - protein, 20 aa, Bacteroides intestinalis CAG:315
VAIIKKYMDEAQIAATPQCF

SEQ ID NO: 779 - protein, 42 aa, Elizabethkingia sp. BM10
KGGGNVCDEFPKKYQHVSCSEYFNIPPKYSHCVLVDVECFPE

SEQ ID NO: 780 - protein, 14 aa, Ruminococcus sp. CAG:382
GYCSKCAEKIRNGQ

SEQ ID NO: 781 - protein, 24 aa, Bacteroides fragilis str. 3783N1-6
DAYYNVISDVAKFTKSNGTVLPNK

SEQ ID NO: 782 - protein, 16 aa, Lactobacillus casei A2-362
AFWQGIGRWLDQHFGW

SEQ ID NO: 783 - protein, 24 aa, Bacteroides fragilis
DAYYNVISDVAKFTKSNGTVLPNK

SEQ ID NO: 784 - protein, 24 aa, Bacteroides fragilis HMW 610
DAYYNVISDVAKFTKSNGTVLPNK

SEQ ID NO: 785 - protein, 24 aa, Bacteroides fragilis CAG:558
DAYYNVISDVAKFTKSNGTVLPNK

SEQ ID NO: 786 - protein, 24 aa, Bacteroides fragilis HMW 616
DAYYNVISDVAKFTKSNGTVLPNK

SEQ ID NO: 787 - protein, 32 aa, Elizabethkingia miricola (Chryseobacterium miricola)
CTSCINYLNGAACYNSHDKSIHVEKCLELPFV

SEQ ID NO: 788 - protein, 22 aa, Elizabethkingia anophelis
WCEKLSACVQSGQYAKSCKSLE

SEQ ID NO: 789 - protein, 22 aa, Elizabethkingia meningoseptica FMS-007
WCEKLSACVQSGQYAKSCKSLE

SEQ ID NO: 790 - protein, 22 aa, Elizabethkingia anophelis R26
WCEKLSACVQSGQYAKSCKSLE

SEQ ID NO: 791 - protein, 13 aa, Chryseobacterium oranimense G311
GVCGSAPKCLATS

SEQ ID NO: 792 - protein, 25 aa, Chryseobacterium oranimense G311
NCVTEYCTEISLACAQTECQPVLEL

SEQ ID NO: 793 - protein, 32 aa, Bacteroides pyogenes F0041
NIFKSIWNWIKEHIFLETSGDPNARIRGGIRF

SEQ ID NO: 794 - protein, 30 aa, Burkholderia sp. RPE64
GAIAAILKDFHIPLSWPSQTAPAAQDPRLL

SEQ ID NO: 795 - protein, 18 aa, Streptococcus pneumoniae
QIAQNLGNYFAKVLLRRS

SEQ ID NO: 796 - protein, 22 aa, Streptococcus constellatus
SGGNGAWGWVGQLAPAFSKKRP

SEQ ID NO: 797 - protein, 13 aa, Lactobacillus rhamnosus
NQYRNAGRHWARN

SEQ ID NO: 798 - protein, 22 aa, Streptococcus intermedius BA1
SGGNGAWGWIGQLAPAFSKKRS

SEQ ID NO: 799 - protein, 22 aa, Streptococcus intermedius B196
SGGNGAWGWIGQLAPAFSKKRS

SEQ ID NO: 800 - protein, 17 aa, [Eubacterium] rectale DSM 17629
GFAGGIATGVSRKNRKK

SEQ ID NO: 801 - protein, 23 aa, Staphylococcus epidermidis
GNFLREAKNLAGDLIETFSPLKG

SEQ ID NO: 802 - protein, 35 aa, Prevotella sp. oral taxon 473 str. F0040
DEGGASLIGIGGIGDGVPHNAYLRIFTFKIRLPWW

SEQ ID NO: 803 - protein, 12 aa, Streptococcus sp. ACS2
DFGRGFVDGFRG

SEQ ID NO: 804 - protein, 12 aa, Streptococcus sp. HSISS3
DFGRGFVDGFRG

SEQ ID NO: 805 - protein, 18 aa, Prevotella sp. F0091
KIAKSIIDAFRHAGEIWA

SEQ ID NO: 806 - protein, 27 aa, Enterococcus raffinosus ATCC 49464
GIIDAAIDFGKGFLDGAKNAKHIGGGY

SEQ ID NO: 807 - protein, 17 aa, Lactobacillus plantarum
AAGDAIVSFGEGFLNAW

SEQ ID NO: 808 - protein, 17 aa, Lactobacillus pentosus IG1
AAGDAIVSFGEGFLNAW

SEQ ID NO: 809 - protein, 37 aa, Cellulosilyticum lentocellum (strain ATCC 49066 / DSM 5427 / NCIMB 11756 / RHM5) (Clostridium lentocellum)
GGFIESAVAKGAMVTLLYAIRPNPKPIIDFIFKVLKK

SEQ ID NO: 810 - protein, 19 aa, Streptococcus suis R61
DYWNGVFDGIKSVFNQNKK

SEQ ID NO: 811 - protein, 41 aa, Serratia plymuthica S13
LGALLGSLGAHLQFNPLLAVAGGALLAGIVISGFTECRLGR

SEQ ID NO: 812 - protein, 28 aa, Coprobacillus sp. CAG:605
LGLAAAIAGGITFLIGIIDGFFRPLSCR

SEQ ID NO: 813 - protein, 18 aa, Lactococcus lactis
GFGKGAIKEGNKDKWKNI

SEQ ID NO: 814 - protein, 26 aa, Streptococcus sp. HSISS3
SWANYLSRYLKEDYKYFLSDGSKNLL

SEQ ID NO: 815 - protein, 22 aa, Bacillus cereus 03BB108
GAGAGLWDAYEESQAKKKKKKK

SEQ ID NO: 816 - protein, 40 aa, uncultured Sphingobacteriia bacterium
ELMKGLGKGIREFNNAKANIESEVKESMKEIDDKEMKSNK

SEQ ID NO: 817 - protein, 22 aa, Bacillus cereus NVH0597-99
GAGAGLWDAYEESQAKKKKKKK

SEQ ID NO: 818 - protein, 22 aa, Bacillus thuringiensis (strain Al Hakam)
GAGAGLWDAYEESQAKKKKKKK

SEQ ID NO: 819 - protein, 31 aa, Caldicellulosiruptor saccharolyticus (strain ATCC 43494 / DSM 8903 / Tp8T 6331)
LGKAYKWIANLIESIFYTLNGIPVSDLYYRG

SEQ ID NO: 820 - protein, 42 aa, Rahnella sp. (strain Y9602)
SGMTGGGGVVAGSYGGLGGMIVSGMGGLIAGSGNCFGNSGGR

SEQ ID NO: 821 - protein, 22 aa, Clostridium sp. CAG:533
VLGAIGAFLAGVLDGYLRPKCN

SEQ ID NO: 822 - protein, 17 aa, Microscilla marina ATCC 23134
RQMVRHLRRFMRRYGRC

SEQ ID NO: 823 - protein, 31 aa, Roseburia inulinivorans DSM 16841
AVITTVGGEGALRCRFLDMGLIPKTKVVVKK

SEQ ID NO: 824 - protein, 39 aa, Ruminococcus sp. SR1/5
GGGHAAAAGVRKRTNDVEKFRQEILEWIVMMRKFSGQDK

SEQ ID NO: 825 - protein, 20 aa, Bacteroides salyersiae CL02T12C01
YEKINGVLTRVFTFSCEVVS

SEQ ID NO: 826 - protein, 36 aa, Firmicutes bacterium CAG:460
LDSINGGGKKLWYLLGAGLSFFLGLFSGLVNPVKCN

SEQ ID NO: 827 - protein, 39 aa, Blautia sp. KLE 1732
GGGDAAAAGVRKRTNDVEKFRQEILERIVMMRKFFGQDK

SEQ ID NO: 828 - protein, 36 aa, Chitinophaga pinensis (strain ATCC 43595 / DSM 2588 / NCIB 11800 / UQM 2034)
AEKMNNLWGGGGIIMNTTDVSGRPQCDTRETAMLTL

SEQ ID NO: 829 - protein, 26 aa, Lachnospiraceae bacterium 10-1
TQVKQFFEKGAKSAMENKTQLMKFLQ

SEQ ID NO: 830 - protein, 27 aa, Lactobacillus reuteri 100-23
ELVKDVVNSLNKWAQSCYAGYKDSPFH

SEQ ID NO: 831 - protein, 26 aa, Firmicutes bacterium CAG:534
AKVKQFFEKGAKSAMENKTQLMKFLQ

SEQ ID NO: 832 - protein, 13 aa, Algoriphagus machipongonensis
DAAKDAIKTFTKL

SEQ ID NO: 833 - protein, 13 aa, Agathobacter rectalis (strain ATCC 33656 / DSM 3377 / JCM 17463 / KCTC 5835 / VPI 0990) (Eubacterium rectale)
GVYNGIKDWFGAC

SEQ ID NO: 834 - protein, 38 aa, Lactobacillus curvatus CRL 705
GIAGTGAGAAGGPAGAFVGAHVGVIAGSAVCIGGFLGQ

SEQ ID NO: 835 - protein, 27 aa, Lactobacillus curvatus CRL 705
DWGTAIGNIGNNAAANWATGGNAGWNK

SEQ ID NO: 836 - protein, 40 aa, Streptococcus gallolyticus subsp. gallolyticus TX20005
NMGSAIGGCIGGVLLAAATGPITGGGAAMICVASGISAYL

SEQ ID NO: 837 - protein, 40 aa, Streptococcus gallolyticus (strain ATCC 43143 / F-1867); identical to SEQ ID NO: 836

SEQ ID NO: 838 - protein, 40 aa, Streptococcus gallolyticus; identical to SEQ ID NO: 836

SEQ ID NO: 839 - protein, 27 aa, Lactobacillus sakei
DWGTAIGNIGNNAAANWATGGNAGWNK

SEQ ID NO: 840 - protein, 38 aa, Lactobacillus sakei; identical to SEQ ID NO: 834

SEQ ID NO: 841 - protein, 42 aa, Lactobacillus sakei
TNWGSVVGSCVAGGLVGALGGTPISIGAGCLVGAGQDWISQK

SEQ ID NO: 842 - protein, 31 aa, Caldicellulosiruptor kristjanssonii (strain ATCC 700853 / DSM 12137 / I77R1B)
LGKLYKWITNVIDNIFYTPKGIPCPDDVYRG

SEQ ID NO: 843 - protein, 17 aa, Streptococcus tigurinus 2426
GYIGGGNHLCKGSAARF

SEQ ID NO: 844 - protein, 20 aa, Echinicola vietnamensis (strain DSM 17526 / LMG 23754 / KMM 6221)
AGLGFASSFASVMSCNGVYL

SEQ ID NO: 845 - protein, 20 aa, Streptococcus equi subsp. zooepidemicus (strain MGCS10565)
IVNGWISSLGGGYFHPGYRG

SEQ ID NO: 846 - protein, 27 aa, Lactobacillus curvatus
DWGTAIGNIGNNAAANWATGGNAGWNK

SEQ ID NO: 847 - protein, 27 aa, Nitritalea halalkaliphila LW7
GAYGAGYAVGKAYAHYKNSQEVPVVAE

SEQ ID NO: 848 - protein, 11 aa, Capnocytophaga canimorsus
TAGAAYSGCFD

SEQ ID NO: 849 - protein, 15 aa, Carnobacterium maltaromaticum (Carnobacterium piscicola)
GWLAGAAGVINSCMK

SEQ ID NO: 850 - protein, 21 aa, Lactobacillus paracasei subsp. paracasei ATCC 25302
GGLGILGGVGGAIYGASESCF

SEQ ID NO: 851 - protein, 22 aa, Streptococcus pneumoniae
QLLGSICGFIDGISKSTNRGQC

SEQ ID NO: 852 - protein, 21 aa, Lactobacillus paracasei subsp. paracasei Lpp14
GGLGILGGVGGAIYGASESCF

SEQ ID NO: 853 - protein, 21 aa, Lactobacillus paracasei subsp. paracasei Lpp7
GGLGILGGVGGAIYGASESCF

SEQ ID NO: 854 - protein, 21 aa, Lactobacillus casei (strain ATCC 334)
GGLGILGGVGGAIYGASESCF

SEQ ID NO: 855 - protein, 12 aa, Bacteroides fragilis str. J-143-4
GDGGGGTAVGHF

SEQ ID NO: 856 - protein, 12 aa, Bacteroides fragilis str. 1007-1-F #3
GDGGGGTAVGHF

SEQ ID NO: 857 - protein, 12 aa, Bacteroides sp. 2_1_56FAA
GDGGGGTAVGHF

SEQ ID NO: 858 - protein, 22 aa, Streptococcus infantarius subsp. infantarius ATCC BAA-102
QGFGAICSFIDGFNGKKYRGKC

SEQ ID NO: 859 - protein, 22 aa, Streptococcus infantarius subsp. infantarius
QGFGAICSFIDGFNGKKYRGKC

SEQ ID NO: 860 - protein, 36 aa, Saccharopolyspora rectivirgula
QRVHAACNELLRGQRAAVEDRSCGDPVELSGSGRRP

SEQ ID NO: 861 - protein, 38 aa, Streptococcus equi subsp. ruminatorum CECT 5772
GCASRGVKLGSRIGPWGAVIGGVGSAAVCGYLAYKASS

SEQ ID NO: 862 - protein, 38 aa, Streptococcus equi subsp. zooepidemicus (strain MGCS10565); identical to SEQ ID NO: 861

SEQ ID NO: 863 - protein, 38 aa, Streptococcus equi subsp. zooepidemicus SzAM60; identical to SEQ ID NO: 861

SEQ ID NO: 864 - protein, 38 aa, Streptococcus equi subsp. zooepidemicus Sz16; identical to SEQ ID NO: 861

SEQ ID NO: 865 - protein, 38 aa, Streptococcus equi subsp. zooepidemicus Sz4is; identical to SEQ ID NO: 861

SEQ ID NO: 866 - protein, 38 aa, Streptococcus equi subsp. zooepidemicus (strain H70); identical to SEQ ID NO: 861

SEQ ID NO: 867 - protein, 23 aa, Streptococcus pneumoniae
WGAAIGGIGGAVVCGYLAYTATS

SEQ ID NO: 868 - protein, 37 aa, Pedobacter sp. NL19
DQLKELYGGGAHANNMSCITGSKSCPNCKEAEREDYN

SEQ ID NO: 869 - protein, 16 aa, Elizabethkingia sp. BM10
IDDMQKAVEELDAIKC

SEQ ID NO: 870 - protein, 39 aa, Parabacteroides goldsteinii DSM 19448 = WAL 12034
AQGSSIGENYNANVSNGYTESGGGNVACGDGVPATKPTH

SEQ ID NO: 871 - protein, 39 aa, Parabacteroides goldsteinii CL02T12C30; identical to SEQ ID NO: 870

SEQ ID NO: 872 - protein, 39 aa, Parabacteroides goldsteinii dnLKV18; identical to SEQ ID NO: 870

SEQ ID NO: 873 - protein, 27 aa, Bacteroides oleiciplenus YIT 12058
ARGAKEAVDRIRISQEVSSDEVAIVCY

SEQ ID NO: 874 - protein, 21 aa, Elizabethkingia meningoseptica (Chryseobacterium meningosepticum)
GHGIGSLAGACINGVCAGDVI

SEQ ID NO: 875 - protein, 15 aa, Bacteroides sp. CAG:754
MRACYNDYCGASCKK

SEQ ID NO: 876 - protein, 32 aa, Elizabethkingia miricola (Chryseobacterium miricola)
GGCRSIAGAGPDTYLCSPPTSGPKIEPFPIEW

SEQ ID NO: 877 - protein, 32 aa, Elizabethkingia sp. BM10; identical to SEQ ID NO: 876

SEQ ID NO: 878 - protein, 27 aa, Stenotrophomonas maltophilia (Pseudomonas maltophilia) (Xanthomonas maltophilia)
ADDARHAFEKARDAELHRGFQILSHGD

SEQ ID NO: 879 - protein, 27 aa, Stenotrophomonas maltophilia (Pseudomonas maltophilia) (Xanthomonas maltophilia)
ADEARHAFEKARDAELHRGFQILSHGD

SEQ ID NO: 880 - protein, 27 aa, Stenotrophomonas sp. RIT309
ADEARHAYDKARDAELHRGFQILSHGD

SEQ ID NO: 881 - protein, 27 aa, Stenotrophomonas maltophilia JV3
ADEARHAFEKARDAELHRGFQILSHGD

SEQ ID NO: 882 - protein, 27 aa, Stenotrophomonas maltophilia M30
ADDARHAFEKARDAELHRGFQILSHGD

SEQ ID NO: 883 - protein, 28 aa, Lactobacillus paracasei subsp. paracasei Lpp41
HGATTGWSDLGDGIGSMWGGIWNGLNGH

SEQ ID NO: 884 - protein, 26 aa, Stenotrophomonas maltophilia (Pseudomonas maltophilia) (Xanthomonas maltophilia)
SEARAAFDKARDAELHRGFAVLHCSP

SEQ ID NO: 885 - protein, 15 aa, Lactobacillus brevis subsp. gravesensis ATCC 27305
SWIDDFMKGFKKTFC

SEQ ID NO: 886 - protein, 15 aa, Lactobacillus buchneri ATCC 11577
SWIDDFMKGFKKTFC

SEQ ID NO: 887 - protein, 15 aa, Lactobacillus hilgardii DSM 20176 = ATCC 8290
SWIDDFMKGFKKTFC

SEQ ID NO: 888 - protein, 33 aa, Stigmatella aurantiaca (strain DW4/3-1)
KDLITVIGGAAAEKPKHQVTVKPDGTIVIVVYR

SEQ ID NO: 889 - protein, 19 aa, Lactobacillus shenzhenensis LY-73
LDSVKGFLDGLTGHKRHYD

SEQ ID NO: 890 - protein, 39 aa, Prevotella multisaccharivorax DSM 17128
AAGASCGSSGSSKDCDGTAVCNCRCPIIVHKPVEKPSHE

SEQ ID NO: 891 - protein, 19 aa, Streptococcus sp. I-G2
LMGTFAGAFDEYARKRGKH

SEQ ID NO: 892 - protein, 35 aa, Prevotella disiens JCM 6334 = ATCC 29426
EEYCENLRKIIANNKLSEKALAGWTIGYSTHCVEH

SEQ ID NO: 893 - protein, 36 aa, Lachnospiraceae bacterium 3_1_57FAA_CT1
LKEYASCAEDAKVKQFFEQGAKSAMENKQQLMKFLQ

SEQ ID NO: 894 - protein, 29 aa, Geomicrobium sp. JCM 19037
KPVTGFGEQVITWQDHKLVHKKVSATERL

SEQ ID NO: 895 - protein, 26 aa, Lachnospiraceae bacterium 28-4
SSVKQFFEKGARSAMDNKQQLMKFLQ

SEQ ID NO: 896 - protein, 11 aa, Helicobacter bilis
LEGYGAKLCEC

SEQ ID NO: 897 - protein, 16 aa, Streptococcus equi subsp. zooepidemicus SzAM60
NGLTGGNAGWHSGGII

SEQ ID NO: 898 - protein, 18 aa, Leuconostoc pseudomesenteroides
EAFSAGVHRLANGGNGFW

SEQ ID NO: 899 - protein, 37 aa, Providencia rettgeri DSM 1131
NRLVQVVGGWLHSFALVTYFCMLLGSHSFAAYLQPEL

SEQ ID NO: 900 - protein, 16 aa, Streptococcus equi subsp. zooepidemicus CY
NGLTGGNAGWHSGGII

SEQ ID NO: 901 - protein, 37 aa, Exiguobacterium sp. S17
EFGRAAGQTLREFKNATNGMMKEHDETDKKEIEKKEQ

SEQ ID NO: 902 - protein, 37 aa, Exiguobacterium sp. AB2
EFGRAAGQTLREFKNATNGMMKEHDENDKKEIEKKEQ

SEQ ID NO: 903 - protein, 31 aa, Neisseria sp. oral taxon 014 str. F0314
DFWEEMGKGFSKAGDDISDAWKKARDAVHGN

SEQ ID NO: 904 - protein, 18 aa, Streptococcus australis ATCC 700641
LMGTFAGAFDEYARKRGK

SEQ ID NO: 905 - protein, 28 aa, Caldicellulosiruptor kronotskyensis (strain DSM 18902 / VKM B-2412 / 2002)
RAIDGAIEGATGKDIKTHARDFVRSLLD

SEQ ID NO: 906 - protein, 22 aa, Firmicutes bacterium CAG:65
QFFEKGARSAMENKQQLMKFLQ

SEQ ID NO: 907 - protein, 38 aa, Hyphomicrobium nitrativorans NL23
NGVDGGLGVLSVAGSTKKKRPVEMRDLPPRKIPFFTEA

SEQ ID NO: 908 - protein, 30 aa, Streptococcus mitis
TGGGWWEKLLHETILGKFKITKALELPIQL

SEQ ID NO: 909 - protein, 19 aa, Caldicellulosiruptor lactoaceticus 6A
RAIDGAIEGATGKDIKTHA

SEQ ID NO: 910 - protein, 21 aa, Streptococcus sp. HSISB1
TLLTGVFGWLKKFQEKPQKHM

SEQ ID NO: 911 - protein, 15 aa, Lactobacillus gigeriorum DSM 23908 = CRBIP 24.85
KLMDSLCRNFNSKKC

SEQ ID NO: 912 - protein, 19 aa, Streptococcus sp. I-P16
LMGTFAGAFDEYARKRGKY

SEQ ID NO: 913 - protein, 22 aa, Lactobacillus casei LOCK919
LRKVVDAIGSIVNLIPFFGKRA

SEQ ID NO: 914 - protein, 39 aa, Lactococcus garvieae
ETLAQGIKRVYDSIWPNDTAWYTGKNNKTNIPPYSPYGH

SEQ ID NO: 915 - protein, 34 aa, Enterococcus pallens ATCC BAA-351
AVGAGAGGVIGAIGGLLTECVQWGYNETPQHGWN

SEQ ID NO: 916 - protein, 27 aa, Streptococcus anginosus subsp. whileyi CCUG 39159
GGGWLEDLFSPYLKKYKLGKLGQPDLG

SEQ ID NO: 917 - protein, 27 aa, Streptococcus constellatus subsp. pharyngis SK1060 = CCUG 46377
GGGWLEDLFSPYLKKYKLGKLGQPDLG

SEQ ID NO: 918 - protein, 42 aa, Lactococcus garvieae
AGLGNGLKQWNTTGFSEYNIGGGKVNNGKAPTSIPAYNPYGH

SEQ ID NO: 919 - protein, 29 aa, Clostridium perfringens
AAIAKGAAAIGTAYMAGYTLGTHMKKKNP

SEQ ID NO: 920 - protein, 29 aa, Clostridium perfringens E str. JGS1987
AAIAKGAAAIGTAYMAGYTLGTHMKKKNP

SEQ ID NO: 921 - protein, 33 aa, Thalassomonas actiniarum
SGGGKGVNPASAAPITPMADSLFPVKKEEGTTP

SEQ ID NO: 922 - protein, 29 aa, Clostridium perfringens B str. ATCC 3626
AAIAKGAAAIGTAYMAGYTLGTHMKKKNP

SEQ ID NO: 923 - protein, 29 aa, Clostridium perfringens C str. JGS1495
AAIAKGAAAIGTAYMAGYTLGTHMKKKNP

SEQ ID NO: 924 - protein, 20 aa, Eubacterium ramulus ATCC 29099
HRLRALFGGGEEGNTLEQTD

SEQ ID NO: 925 - protein, 32 aa, Streptococcus constellatus
LAATWGATFGGMLAPISLIGSVPGVLAACSGL

SEQ ID NO: 926 - protein, 32 aa, Streptococcus constellatus subsp. pharyngis SK1060 = CCUG 46377; identical to SEQ ID NO: 925

SEQ ID NO: 927 - protein, 21 aa, Candidatus Kuenenia stuttgartiensis
IIEGGIESIKRLVQVTNLIII

SEQ ID NO: 928 - protein, 32 aa, Streptococcus constellatus subsp. constellatus SK53; identical to SEQ ID NO: 925

SEQ ID NO: 929 - protein, 26 aa, Lactobacillus casei
AITKGMAWGAGALAAGIGTGYLINKH

SEQ ID NO: 930 - protein, 23 aa, Streptococcus equi subsp. equi
WGAVIGGVGSAAVCGYLAYKASS

SEQ ID NO: 931 - protein, 40 aa, Anoxybacillus flavithermus (strain DSM 21510 / WK1)
TAAFTGLMTFAGVSGPVGWVLGTFVGGAWLGASAAAGCLK

SEQ ID NO: 932 - protein, 23 aa, Streptococcus equi subsp. equi (strain 4047)
WGAVIGGVGSAAVCGYLAYKASS

SEQ ID NO: 933 - protein, 12 aa, Streptococcus vestibularis ATCC 49124
DFGRGFVDGFRG

SEQ ID NO: 934 - protein, 12 aa, Streptococcus vestibularis F0396
DFGRGFVDGFRG

SEQ ID NO: 935 - protein, 35 aa, Faecalibacterium prausnitzii L2-6
FTALLSLLGGAIYVTFQITWTVSHSDDKNKKNDRL

SEQ ID NO: 936 - protein, 16 aa, Streptococcus equi subsp. ruminatorum CECT 5772
NGLTGGNAGWHSGGII

SEQ ID NO: 937 - protein, 42 aa, Streptococcus pyogenes STAB902
VIGGLGGLASGLKFCKLPHPVLTGGCVVGFTVGGAYLGYTAN

SEQ ID NO: 938 - protein, 42 aa, Streptococcus pyogenes
VIGGLGGLASGLKFCKLPHPVLAGGCVVGFTVGGAYLGYTAN

SEQ ID NO: 939 - protein, 42 aa, Streptococcus dysgalactiae subsp. equisimilis (Streptococcus equisimilis); identical to SEQ ID NO: 937

SEQ ID NO: 940 - protein, 42 aa, Streptococcus pyogenes; identical to SEQ ID NO: 937

SEQ ID NO: 941 - protein, 42 aa, Streptococcus pyogenes GA06023; identical to SEQ ID NO: 938

SEQ ID NO: 942 - protein, 42 aa, Streptococcus pyogenes; identical to SEQ ID NO: 937

SEQ ID NO: 943 - protein, 42 aa, Streptococcus dysgalactiae subsp. equisimilis (strain GGS_124); identical to SEQ ID NO: 937

SEQ ID NO: 944 - protein, 42 aa, Streptococcus pyogenes serotype M4 (strain MGAS10750); identical to SEQ ID NO: 938

SEQ ID NO: 945 - protein, 42 aa, Streptococcus pyogenes serotype M6 (strain ATCC BAA-946 / MGAS10394)
VIGGLGGLASGLKFCKLLHPVLAGGCVVGFTVGGAYLGYTAN

SEQ ID NO: 946 - protein, 42 aa, Streptococcus pyogenes serotype M12 (strain MGAS9429); identical to SEQ ID NO: 945

SEQ ID NO: 947 - protein, 42 aa, Streptococcus pyogenes serotype M28 (strain MGAS6180); identical to SEQ ID NO: 938

SEQ ID NO: 948 - protein, 42 aa, Streptococcus pyogenes serotype M2 (strain MGAS10270); identical to SEQ ID NO: 937

SEQ ID NO: 949 - protein, 42 aa, Streptococcus dysgalactiae subsp. equisimilis 167; identical to SEQ ID NO: 937

SEQ ID NO: 950 - protein, 42 aa, Streptococcus pyogenes serotype M1; identical to SEQ ID NO: 937

SEQ ID NO: 951 - protein, 42 aa, Streptococcus pyogenes serotype M3 (strain ATCC BAA-595 / MGAS315); identical to SEQ ID NO: 937

SEQ ID NO: 952 - protein, 20 aa, Streptococcus sp. HSISS2
GGALLGLAGGAVSYGALCWV

SEQ ID NO: 953 - protein, 20 aa, Streptococcus sp. HSISS1
GGALLGLAGGAVSYGALCWV

SEQ ID NO: 954 - protein, 36 aa, Lactobacillus sp. ASF360
DAGHYAGKAVQALGVGIGIAAGIATLFVAKNTNGDK

SEQ ID NO: 955 - protein, 38 aa, Bacillus azotoformans MEV2011
KKLETYAQNCADPELKAILQRDAQAAKQSQQQLMTFLG

SEQ ID NO: 956 - protein, 27 aa, Streptococcus intermedius F0395
GGGWLEDLFSPYLKKYKLGKLGQHDLG

SEQ ID NO: 957 - protein, 12 aa, Xenorhabdus szentirmaii DSM 16338
QFCQSGIHFLST

SEQ ID NO: 958 - protein, 42 aa, Bacillus mycoides Rock1-4
ATVANKLDQYAHQCTDPQLKQMLQQDAQAARNTKQQLMSFLG

SEQ ID NO: 959 - protein, 36 aa, Cystobacter fuscus DSM 2262
GGGRGGRDGRGGRGGRGGRGGRGGRGGYYGGYYYDD

SEQ ID NO: 960 - protein, 32 aa, Lactobacillus gasseri SV-16A-US
GGKAVNGFVNGNFSSRISLFCTFTKNDSKINE

SEQ ID NO: 961 - protein, 32 aa, Lactobacillus gasseri 224-1; identical to SEQ ID NO: 960

SEQ ID NO: 962 - protein, 21 aa, Firmicutes bacterium CAG:321
QIGESLGNYIRRKTENKMCDI

SEQ ID NO: 963 - protein, 21 aa, Clostridium sp. CAG:302
NIGEAFGSYIRRKSEGKMCDF

SEQ ID NO: 964 - protein, 18 aa, Bacillus weihenstephanensis
VGAVYTAGYTLGKMNGRR

SEQ ID NO: 965 - protein, 30 aa, Cellulophaga lytica (strain ATCC 23178 / DSM 7489 / JCM 8516 / NBRC 14961 / NCIMB 1423 / VKM B-1433 / Cy l20)
ELMRGLGSGIKEFKDASKDDDSNDKLEEKK

SEQ ID NO: 966 - protein, 30 aa, Microscilla marina ATCC 23134
RGGESIATNCAACEGCQPNAKETDVPSQAQ

SEQ ID NO: 967 - protein, 13 aa, Desulfotomaculum gibsoniae DSM 7213
AQEFQQMMNKFPQ

SEQ ID NO: 968 - protein, 41 aa, Butyrivibrio proteoclasticus (strain ATCC 51982 / DSM 14932 / B316) (Clostridium proteoclasticum)
KYYTAICATYQAALDLCARVGVDPSTIDVTDNPFPSWGFGA

SEQ ID NO: 969 - protein, 17 aa, Streptococcus sp. I-P16
SVFNAGYKFGADLARRR

SEQ ID NO: 970 - protein, 37 aa, Streptococcus sp. SK140
ELMNTAGGSITIATVGAGLAIFLGGRLIGQDLKRKFG

SEQ ID NO: 971 - protein, 42 aa, Catenovulum agarivorans DS-2
GGFSAGFTAGAGIGAAVGGPMAPATALIGGMTGEGVRKSVSA

SEQ ID NO: 972 - protein, 38 aa, Bacillus cereus VD166
GAAAGALGGSAAFGIGAFGGAILGVNVGAAAGAIRCLA

SEQ ID NO: 973 - protein, 41 aa, Lactobacillus casei 21/1
WGKVGAAGVGCGLITWWTGPGAVADGALCAATQFFGEVLKN

SEQ ID NO: 974 - protein, 41 aa, Lactobacillus paracasei subsp. paracasei 8700:2; identical to SEQ ID NO: 973

SEQ ID NO: 975 - protein, 41 aa, Lactobacillus paracasei subsp. paracasei Lpp123; identical to SEQ ID NO: 973

SEQ ID NO: 976 - protein, 25 aa, Streptococcus oralis SK304
AAYGAAATVAGGTLGLGVYNGYRGR

SEQ ID NO: 977 - protein, 25 aa, Streptococcus sp. oral taxon 071 str. 73H25AP
AAYGAAATLAGGTLGLGVYNGYRGR

SEQ ID NO: 978 - protein, 25 aa, Streptococcus sp. F0441
AAYGAAATVAGGTLGLGVYNGYRGR

SEQ ID NO: 979 - protein, 19 aa, Pseudoalteromonas sp. BSi20429
VASFAAIISGIATYNAIRK

SEQ ID NO: 980 - protein, 36 aa, Firmicutes bacterium CAG:24
MQEYAECAQDAKVKQFFEKGAKSAMENKQALMDFLR

SEQ ID NO: 981 - protein, 22 aa, Clostridium sp. CAG:91
QFFEKGARSAMENKQQLMKFLQ

SEQ ID NO: 982 - protein, 17 aa, Clostridium perfringens (strain SM101 / Type A)
IANGWAGSAAGGYFSGR

SEQ ID NO: 983 - protein, 21 aa, Lachnospiraceae bacterium 8_1_57FAA
KLFQEAADSAMKNKQELMKFL

SEQ ID NO: 984 - protein, 21 aa, Ruminococcus torques CAG:61
KLFQEAADSAMKNKQELMKFL

SEQ ID NO: 985 - protein, 22 aa, Clostridium sp. KLE 1755
QFFEQGAKSAMENKQQLMKFLQ

SEQ ID NO: 986 - protein, 21 aa, Ruminococcus torques ATCC 27756
KLFQEAADSAMKNKQELMKFL

SEQ ID NO: 987 - protein, 40 aa, Streptococcus infantarius subsp. infantarius ATCC BAA-102
NLGSAIGGCIGGVILAAATGPLTGGAAALVCVGSGLSAYL

SEQ ID NO: 988 - protein, 36 aa, Clostridium argentinense CDC 2741
DGVKAAVNKLAHTPYERTVTRHGEKYTVKYDGNPGW

SEQ ID NO: 989 - protein, 21 aa, Rhizobium etli bv. mimosae str. Mim1
RFVQAWADSVDGEKPISLPPQ

SEQ ID NO: 990 - protein, 24 aa, Clostridium sp. CAG:417
LIDAGIGVGSAIRRVHDDKLCPLE

SEQ ID NO: 991 - protein, 42 aa, Bacillus cereus HuA3-9
ATIINKLEQYAQACTDPKLKQMLEKDAQDARNTKQQLMTFLG

SEQ ID NO: 992 - protein, 42 aa, Bacillus cereus AH603; identical to SEQ ID NO: 991

SEQ ID NO: 993 - protein, 21 aa, [Clostridium] hylemonae DSM 15053
KLFQDAANSAMKNKQDLMKFL

SEQ ID NO: 994 - protein, 42 aa, Lactobacillus delbrueckii subsp. bulgaricus PB2003/044-T3-4
LEQIVGGGIEGFGIYIGGATQVKNSEASLIFRLLHHKRHGRN

SEQ ID NO: 995 - protein, 17 aa, Streptococcus salivarius SK126
GAIAGGADEYARKRGHH

SEQ ID NO: 996 - protein, 42 aa, Bacillus sp. L_1B0_8
ATIINKLEQYAQTCTDPQLKQMLQKDAQDARNTKQQLMTFLG

SEQ ID NO: 997 - protein, 42 aa, Bacillus thuringiensis Sbt003; identical to SEQ ID NO: 996

SEQ ID NO: 998 - protein, 42 aa, Bacillus sp. L_1B0_5; identical to SEQ ID NO: 996

SEQ ID NO: 999 - protein, 18 aa, Lactococcus garvieae
GVISNGWGSAGAGFGPQH

SEQ ID NO: 1000 - protein, 42 aa, Streptococcus pneumoniae; identical to SEQ ID NO: 996

SEQ ID NO: 1001 - protein, 42 aa, Bacillus thuringiensis T01-328; identical to SEQ ID NO: 996

SEQ ID NO: 1002 - protein, 42 aa, Bacillus cereus; identical to SEQ ID NO: 996

SEQ ID NO: 1003 - protein, 40 aa, Thalassomonas viridans
SGIHNGADPAAHTVAVPAADSLVMAPFNSDSNDDKGITGK

SEQ ID NO: 1004 - protein, 42 aa, Bacillus cereus
ATIISKLEQYAQTCTDPQLKQMLQKDAQDARNTKQQLMTFLG

SEQ ID NO: 1005 - protein, 42 aa, Bacillus thuringiensis; identical to SEQ ID NO: 996

SEQ ID NO: 1006 - protein, 42 aa, Bacillus anthracis; identical to SEQ ID NO: 996

SEQ ID NO: 1007 - protein, 42 aa, Bacillus cereus ATCC 10876; identical to SEQ ID NO: 996

SEQ ID NO: 1008 - protein, 42 aa, Bacillus cereus VD022; identical to SEQ ID NO: 996

SEQ ID NO: 1009 - protein, 42 aa, Bacillus cereus BDRD-Cer4; identical to SEQ ID NO: 996

SEQ ID NO: 1010 - protein, 42 aa, Bacillus weihenstephanensis FSL H7-687
ATIINKLEQYAQACTDPQLKQMLQKDAQDARNTKQQLMTFLG

SEQ ID NO: 1011 - protein, 42 aa, Bacillus cereus BAG2O-3; identical to SEQ ID NO: 1010

SEQ ID NO: 1012 - protein, 42 aa, Bacillus cereus HuB1-1
ATIINKLEQYAQTCTDPQLKQMLQKDAQDARNTKQQLLTFLG

SEQ ID NO: 1013 - protein, 42 aa, Bacillus cereus MSX-A1; identical to SEQ ID NO: 996

SEQ ID NO: 1014 - protein, 42 aa, Bacillus cereus BAG1X2-3; identical to SEQ ID NO: 996

SEQ ID NO: 1015 - protein, 42 aa, Bacillus cereus str. Schrouff; identical to SEQ ID NO: 996

SEQ ID NO: 1016 - protein, 42 aa, Bacillus thuringiensis serovar monterrey BGSC 4AJ1; identical to SEQ ID NO: 996

SEQ ID NO: 1017 - protein, 42 aa, Bacillus cereus VD140; identical to SEQ ID NO: 996

SEQ ID NO: 1018 - protein, 42 aa, Bacillus cereus BGSC 6E1; identical to SEQ ID NO: 996

SEQ ID NO: 1019 - protein, 42 aa, Bacillus thuringiensis serovar pondicheriensis BGSC 4BA1; identical to SEQ ID NO: 996

SEQ ID NO: 1020 - protein, 42 aa, Bacillus thuringiensis serovar mexicanensis; identical to SEQ ID NO: 996

SEQ ID NO: 1021 - protein, 42 aa, Bacillus thuringiensis subsp. konkukian (strain 97-27); identical to SEQ ID NO: 996

SEQ ID NO: 1022 - protein, 42 aa, Bacillus thuringiensis serovar andalousiensis BGSC 4AW1; identical to SEQ ID NO: 996

SEQ ID NO: 1023 - protein, 42 aa, Bacillus thuringiensis serovar berliner ATCC 10792; identical to SEQ ID NO: 996

SEQ ID NO: 1024 - protein, 42 aa, Bacillus cereus BDRD-ST26; identical to SEQ ID NO: 996

SEQ ID NO: 1025 - protein, 42 aa, Bacillus cereus Rock1-15; identical to SEQ ID NO: 996

SEQ ID NO: 1026 - protein, 42 aa, Bacillus cereus VD184; identical to SEQ ID NO: 996

SEQ ID NO: 1027 - protein, 42 aa, Bacillus cereus BAG1O-3; identical to SEQ ID NO: 996

SEQ ID NO: 1028 - protein, 42 aa, Bacillus cereus 95/8201; identical to SEQ ID NO: 996

SEQ ID NO: 1029 - protein, 42 aa, Bacillus anthracis str. H9401; identical to SEQ ID NO: 996

SEQ ID NO: 1030 - protein, 42 aa, Bacillus cereus AH1134; identical to SEQ ID NO: 996

SEQ ID NO: 1031 - protein, 42 aa, Bacillus sp. 7_6_55CFAA_CT2; identical to SEQ ID NO: 996

SEQ ID NO: 1032 - protein, 42 aa, Bacillus cereus BAG2O-1; identical to SEQ ID NO: 996

SEQ ID NO: 1033 - protein, 42 aa, Bacillus cereus (strain ATCC 10987 / NRS 248); identical to SEQ ID NO: 996

SEQ ID NO: 1034 - protein, 42 aa, Bacillus cereus (strain Q1); identical to SEQ ID NO: 996

SEQ ID NO: 1035 - protein, 42 aa, Bacillus cereus B5-2; identical to SEQ ID NO: 1010

SEQ ID NO: 1036 - protein, 42 aa, Bacillus sp. GeD10; identical to SEQ ID NO: 996

SEQ ID NO: 1037 - protein, 42 aa, Bacillus cereus VD045; identical to SEQ ID NO: 996

SEQ ID NO: 1038 - protein, 42 aa, Bacillus cereus MSX-D12; identical to SEQ ID NO: 996

SEQ ID NO: 1039 - protein, 42 aa, Bacillus cereus MM3; identical to SEQ ID NO: 996

SEQ ID NO: 1040 - protein, 42 aa, Bacillus thuringiensis subsp. galleriae; identical to SEQ ID NO: 996

SEQ ID NO: 1041 - protein, 42 aa, Bacillus cereus BAG1X2-2; identical to SEQ ID NO: 996

SEQ ID NO: 1042 - protein, 42 aa, Bacillus cereus 03BB108; identical to SEQ ID NO: 996

SEQ ID NO: 1043 - protein, 42 aa, Bacillus cereus G9241; identical to SEQ ID NO: 996

SEQ ID NO: 1044 - protein, 42 aa, Bacillus thuringiensis subsp. tolworthi; identical to SEQ ID NO: 996

SEQ ID NO: 1045 - protein, 42 aa, Bacillus cereus VD154; identical to SEQ ID NO: 996

SEQ ID NO: 1046 - protein, 42 aa, Bacillus thuringiensis serovar huazhongensis BGSC 4BD1; identical to SEQ ID NO: 996

SEQ ID NO: 1047 - protein, 42 aa, Bacillus cereus VD014; identical to SEQ ID NO: 996

SEQ ID NO: 1048 - protein, 42 aa, Bacillus thuringiensis serovar tochigiensis BGSC 4Y1; identical to SEQ ID NO: 996

SEQ ID NO: 1049 - protein, 42 aa, Bacillus thuringiensis subsp. morrisoni; identical to SEQ ID NO: 996

SEQ ID NO: 1050 - protein, 42 aa, Bacillus weihenstephanensis; identical to SEQ ID NO: 1010

SEQ ID NO: 1051 - protein, 42 aa, Bacillus cereus F65185; identical to SEQ ID NO: 996

SEQ ID NO: 1052 - protein, 42 aa, Bacillus cereus HuA4-10; identical to SEQ ID NO: 1010

SEQ ID NO: 1053 - protein, 42 aa, Bacillus cereus BAG1X2-1; identical to SEQ ID NO: 996

SEQ ID NO: 1054 - protein, 42 aa, Bacillus thuringiensis subsp. finitimus (strain YBT-020); identical to SEQ ID NO: 996

SEQ ID NO: 1055 - protein, 42 aa, Bacillus thuringiensis subsp. kurstaki; identical to SEQ ID NO: 996

SEQ ID NO: 1056 - protein, 42 aa, Bacillus cereus NVH0597-99; identical to SEQ ID NO: 996

SEQ ID NO: 1057 - protein, 42 aa, Bacillus cereus VD169; identical to SEQ ID NO: 996

SEQ ID NO: 1058 - protein, 42 aa, Bacillus thuringiensis YBT-1518; identical to SEQ ID NO: 996

SEQ ID NO: 1059 - protein, 42 aa, Bacillus cereus TIAC219; identical to SEQ ID NO: 996

SEQ ID NO: 1060 - protein, 42 aa, Bacillus cereus BAG1X1-1; identical to SEQ ID NO: 996

SEQ ID NO: 1061 - protein, 42 aa, Bacillus thuringiensis (strain Al Hakam); identical to SEQ ID NO: 996

SEQ ID NO: 1062 - protein, 42 aa, Bacillus cereus VD196; identical to SEQ ID NO: 996

SEQ ID NO: 1063 - protein, 42 aa, Bacillus sp. UMTAT18; identical to SEQ ID NO: 996

SEQ ID NO: 1064 - protein, 42 aa, Bacillus cereus 172560W; identical to SEQ ID NO: 996

SEQ ID NO: 1065 - protein, 42 aa, Bacillus thuringiensis serovar pulsiensis BGSC 4CC1; identical to SEQ ID NO: 996

SEQ ID NO: 1066 - protein, 42 aa, Bacillus cereus HuB13-1; identical to SEQ ID NO: 996

SEQ ID NO: 1067 - protein, 42 aa, Bacillus cereus HuA2-4; identical to SEQ ID NO: 1010

SEQ ID NO: 1068 - protein, 42 aa, Bacillus thuringiensis serovar pakistani str. T13001; identical to SEQ ID NO: 996

SEQ ID NO: 1069 - protein, 42 aa, Bacillus cereus (strain B4264); identical to SEQ ID NO: 996

SEQ ID NO: 1070 - protein, 42 aa, Bacillus thuringiensis serovar thuringiensis str. IS5056; identical to SEQ ID NO: 996

SEQ ID NO: 1071 - protein, 42 aa, Bacillus cereus m1293; identical to SEQ ID NO: 996

SEQ ID NO: 1072 - protein, 42 aa, Bacillus cereus BAG4O-1; identical to SEQ ID NO: 996

SEQ ID NO: 1073 - protein, 42 aa, Bacillus cereus HuB4-4; identical to SEQ ID NO: 996

SEQ ID NO: 1074 - protein, 42 aa, Bacillus bombysepticus str. Wang; identical to SEQ ID NO: 996

SEQ ID NO: 1075 - protein, 42 aa, Bacillus cereus (strain ATCC 14579 / DSM 31 / JCM 2152 / NBRC 15305 / NCIMB 9373 / NRRL B-3711); identical to SEQ ID NO: 996

SEQ ID NO: 1076 - protein, 42 aa, Bacillus cereus BAG1X1-2; identical to SEQ ID NO: 1012

SEQ ID NO: 1077 - protein, 42 aa, Bacillus cereus VD156; identical to SEQ ID NO: 996

SEQ ID NO: 1078 - protein, 42 aa, Bacillus thuringiensis HD-771; identical to SEQ ID NO: 996

SEQ ID NO: 1079 - protein, 42 aa, Bacillus cereus ISP2954; identical to SEQ ID NO: 996

SEQ ID NO: 1080 - protein, 42 aa, Bacillus cereus Rock4-2; identical to SEQ ID NO: 996

SEQ ID NO: 1081 - protein, 42 aa, Bacillus cereus var. anthracis (strain CI); identical to SEQ ID NO: 996

SEQ ID NO: 1082 - protein, 42 aa, Bacillus cereus BAG2X1-3; identical to SEQ ID NO: 1010

SEQ ID NO: 1083 - protein, 42 aa, Bacillus cereus Rock3-42; identical to SEQ ID NO: 996

SEQ ID NO: 1084 - protein, 42 aa, Bacillus cereus (strain AH187); identical to SEQ ID NO: 996

SEQ ID NO: 1085 - protein, 42 aa, Bacillus cereus (strain ZK / E33L); identical to SEQ ID NO: 996

SEQ ID NO: 1086 - protein, 42 aa, Bacillus thuringiensis (strain BMB171); identical to SEQ ID NO: 996

SEQ ID NO: 1087 - protein, 42 aa, Bacillus cereus K-5975c; identical to SEQ ID NO: 996

SEQ ID NO: 1088 - protein, 42 aa, Bacillus cereus VD166; identical to SEQ ID NO: 996

SEQ ID NO: 1089 - protein, 42 aa, Bacillus cereus (strain AH820); identical to SEQ ID NO: 996

SEQ ID NO: 1090 - protein, 42 aa, Bacillus weihenstephanensis (strain KBAB4); identical to SEQ ID NO: 1010

SEQ ID NO: 1091 - protein, 42 aa, Bacillus cereus (strain G9842); identical to SEQ ID NO: 996

SEQ ID NO: 1092 - protein, 42 aa, Bacillus thuringiensis HD1002; identical to SEQ ID NO: 996

SEQ ID NO: 1093 - protein, 42 aa, Bacillus cereus VD200; identical to SEQ ID NO: 996

SEQ ID NO: 1094 - protein, 42 aa, Bacillus cereus m1550; identical to SEQ ID NO: 996

SEQ ID NO: 1095 - protein, 42 aa, Bacillus thuringiensis IBL 200; identical to SEQ ID NO: 996

SEQ ID NO: 1096 - protein, 42 aa, Bacillus cereus VD133; identical to SEQ ID NO: 996

SEQ ID NO: 1097 - protein, 42 aa, Bacillus weihenstephanensis FSL R5-860; identical to SEQ ID NO: 996

SEQ ID NO: 1098 - protein, 42 aa, Bacillus cereus AH1271; identical to SEQ ID NO: 996

SEQ ID NO: 1099 - protein, 42 aa, Bacillus cereus FRI-35; identical to SEQ ID NO: 996

SEQ ID NO: 1100 - protein, 42 aa, Bacillus cereus BAG2X1-1; identical to SEQ ID NO: 1010

SEQ ID NO: 1101 - protein, 42 aa, Bacillus cereus ATCC 4342; identical to SEQ ID NO: 996

SEQ ID NO: 1102 - protein, 42 aa, Bacillus cereus BDRD-ST196; identical to SEQ ID NO: 1010

SEQ ID NO: 1103 - protein, 42 aa, Bacillus thuringiensis DB27; identical to SEQ ID NO: 996

SEQ ID NO: 1104 - protein, 42 aa, Bacillus cereus VD102; identical to SEQ ID NO: 996

SEQ ID NO: 1105 - protein, 20 aa, Streptococcus thermophilus JIM 8232
AGAAGGAIVGGVGYGATCWW

SEQ ID NO: 1106 - protein, 20 aa, Streptococcus salivarius
AGAAGGAIVGGVGYGATCWW

SEQ ID NO: 1107 - protein, 20 aa, Streptococcus thermophilus TH1435
AGAAGGAIVGGVGYGATCWW

SEQ ID NO: 1108 - protein, 20 aa, Streptococcus thermophilus M17PTZA496
AGAAGGAIVGGVGYGATCWW

SEQ ID NO: 1109 - protein, 20 aa, Streptococcus thermophilus TH1477
AGAAGGAIVGGVGYGATCWW

SEQ ID NO: 1110 - protein, 20 aa, Streptococcus salivarius
AGAAGGAIVGGVGYGATCWW

SEQ ID NO: 1111 - protein, 20 aa, Streptococcus sp. HSISS2
AGAAGGAIVGGVGYGATCWW

SEQ ID NO: 1112 - protein, 20 aa, Streptococcus sp. HSISS1
AGAAGGAIVGGVGYGATCWW

SEQ ID NO: 1113 - protein, 20 aa, Streptococcus sp. SR4
AGAAGGAIVGGVGYGATCWW

SEQ ID NO: 1114 - protein, 42 aa, Streptococcus suis D12
ALSGAYQAGQQCILAGPQAYLICAAGGAVVGGLIAYGLRPPK

SEQ ID NO: 1115 - protein, 27 aa, Streptococcus sp. AS20
GGGWLEDLFSPYLKKYKLGKLGQPDLG

SEQ ID NO: 1116 - protein, 27 aa, Streptococcus constellatus
GGGWLEDLFSPYLKKYKLGKLGQPDLG

SEQ ID NO: 1117 - protein, 29 aa, Enterococcus faecium (Streptococcus faecium)
AVIGGALGGLGGAGGGCLTGAIGSIWDQW

SEQ ID NO: 1118 - protein, 33 aa, Lactococcus lactis subsp. cremoris UC509.9
AAMGGAIGAFGGPVGAIMGAWGGAVGGAMKYSI

SEQ ID NO: 1119 - protein, 20 aa, Streptococcus thermophilus (strain ATCC BAA-250 / LMG 18311)
AGAAGGAIVGGVGYGATCWW

SEQ ID NO: 1120 - protein, 20 aa, Streptococcus salivarius (strain JIM8777)
AGAAGGAIVGGVGYGATCWW

SEQ ID NO: 1121 - protein, 20 aa, Streptococcus salivarius (strain 57.I)
AGAAGGAIVGGVGYGATCWW

SEQ ID NO: 1122 - protein, 20 aa, Streptococcus salivarius (strain CCHSS3)
AGAAGGAIVGGVGYGATCWW

SEQ ID NO: 1123 - protein, 33 aa, Lactococcus lactis subsp. cremoris TIFN7; identical to SEQ ID NO: 1118

SEQ ID NO: 1124 - protein, 13 aa, Leuconostoc gelidum (strain JB7)
AVAGGVYAGYKSR

SEQ ID NO: 1125 - protein, 29 aa, Enterococcus faecium EnGen0263
AIIGGALGGLGGAGGGCLTGAIGSIWDQW

SEQ ID NO: 1126 - protein, 33 aa, Lactococcus lactis subsp. cremoris TIFN1; identical to SEQ ID NO: 1118

SEQ ID NO: 1127 - protein, 42 aa, Bacillus cereus BAG5X2-1
ATIINKLDQYAQACTDPQLKQMLQKDAQDARNTKQQLMTFLG

SEQ ID NO: 1128 - protein, 42 aa, Bacillus cereus VD021; identical to SEQ ID NO: 1127

SEQ ID NO: 1129 - protein, 42 aa, Bacillus cereus BAG6X1-1; identical to SEQ ID NO: 1127

SEQ ID NO: 1130 - protein, 42 aa, Bacillus cereus VDM053; identical to SEQ ID NO: 1127

SEQ ID NO: 1131 - protein, 42 aa, Bacillus cereus VDM022; identical to SEQ ID NO: 1127

SEQ ID NO: 1132 - protein, 42 aa, Bacillus mycoides; identical to SEQ ID NO: 1127

SEQ ID NO: 1133 - protein, 42 aa, Bacillus cereus BAG1O-1; identical to SEQ ID NO: 1127

SEQ ID NO: 1134 - protein, 42 aa, Bacillus cereus VDM019; identical to SEQ ID NO: 1127

SEQ ID NO: 1135 - protein, 42 aa, Bacillus cereus VD146; identical to SEQ ID NO: 1127

SEQ ID NO: 1136 - protein, 42 aa, Bacillus cereus BAG3O-1; identical to SEQ ID NO: 1127

SEQ ID NO: 1137 - protein, 42 aa, Bacillus cereus; identical to SEQ ID NO: 1127

SEQ ID NO: 1138 - protein, 42 aa, Bacillus weihenstephanensis; identical to SEQ ID NO: 1127

SEQ ID NO: 1139 - protein, 42 aa, Bacillus cereus BAG1X1-3; identical to SEQ ID NO: 1127

SEQ ID NO: 1140 - protein, 42 aa, Bacillus cereus VD078; identical to SEQ ID NO: 1127

SEQ ID NO: 1141 - protein, 42 aa, Bacillus cereus AH1272; identical to SEQ ID NO: 1127

SEQ ID NO: 1142 - protein, 42 aa, Bacillus cereus VD048; identical to SEQ ID NO: 1127

SEQ ID NO: 1143 - protein, 42 aa, Bacillus cereus AH621; identical to SEQ ID NO: 1127

SEQ ID NO: 1144 - protein, 42 aa, Bacillus cereus BAG3X2-1; identical to SEQ ID NO: 1127

SEQ ID NO: 1145 - protein, 42 aa, Bacillus cereus R309803; identical to SEQ ID NO: 1127

SEQ ID NO: 1146 - protein, 33 aa, Capnocytophaga cynodegmi
SAWGLMATGVGAPVGVAALGYILSTPSLAGCFL

SEQ ID NO: 1147 - protein, 21 aa, Lachnospiraceae bacterium 3-2
QLFQDAANSAMKNKQDLMKFL

SEQ ID NO: 1148 - protein, 27 aa, Streptococcus constellatus subsp. constellatus SK53
GGGWLEDLFSPYLKKYKLGKLGQPDLG

SEQ ID NO: 1149 - protein, 16 aa, Firmicutes bacterium CAG:884
LIGLVDGYIRPLTCRG

SEQ ID NO: 1150 - protein, 15 aa, Mycoplasma sp. CAG:956
LIGILDGIMRPLACN

SEQ ID NO: 1151 - protein, 16 aa, Lactobacillus paracasei subsp. tolerans Lpl7
SGAKTGWEIANKHKIY

SEQ ID NO: 1152 - protein, 16 aa, Lactobacillus casei LOCK919
SGAKTGWEIANKHKIY

SEQ ID NO: 1153 - protein, 16 aa, Lactobacillus paracasei subsp. paracasei CNCM I-4270
SGAKTGWEIANKHKIY

SEQ ID NO: 1154 - protein, 41 aa, Streptococcus pyogenes serotype M28 (strain MGAS6180)
AIAGGVGAGMATLGVGGVAGAFAGAIAGGLTCVGGMLFNGK

SEQ ID NO: 1155 - protein, 42 aa, Bacillus mycoides
ATVANKLDQYAQQCTDPQLKQMLQQDAQAARNTKQQLMSFLG

SEQ ID NO: 1156 - protein, 42 aa, Bacillus manliponensis
GTIIHKLEQYAQNCTDPQLKSLLQKDIQDAQNTKQQLMSFLG

SEQ ID NO: 1157 - protein, 42 aa, Bacillus cereus VDM006
ATVANKLDQYAQQCTDPQLKQMLQQDAQAARNTRQQLMSFLG

SEQ ID NO: 1158 - protein, 42 aa, Bacillus thuringiensis (strain Al Hakam); identical to SEQ ID NO: 1155

SEQ ID NO: 1159 - protein, 42 aa, Bacillus gaemokensis; identical to SEQ ID NO: 1155

SEQ ID NO: 1160 - protein, 42 aa, Bacillus pseudomycoides DSM 12442; identical to SEQ ID NO: 1155

SEQ ID NO: 1161 - protein, 42 aa, Bacillus cytotoxicus (strain DSM 22905 / CIP 110041 / 391-98 / NVH 391-98)
TTIANKLDQYAQQCTDPQLKQILQQDAQAARNTKQQLMSFLG

SEQ ID NO: 1162 - protein, 42 aa, Bacillus cereus VDM021; identical to SEQ ID NO: 1157

SEQ ID NO: 1163 - protein, 42 aa, Bacillus cereus VD136; identical to SEQ ID NO: 1157

SEQ ID NO: 1164 - protein, 21 aa, Ruminococcus gnavus ATCC 29149
QLFQEAADSALKNKQDLMKFL

SEQ ID NO: 1165 - protein, 21 aa, Dorea sp. 5-2
KLFQDAADSAMKNKQDLMKFL

SEQ ID NO: 1166 - protein, 21 aa, Ruminococcus gnavus CAG:126
QLFQEAADSALKNKQDLMKFL

SEQ ID NO: 1167 - protein, 21 aa, Ruminococcus gnavus CC55_001C
QLFQEAADSALKNKQDLMKFL

SEQ ID NO: 1168 - protein, 21 aa, Lachnospiraceae bacterium 2_1_58FAA
QLFQEAADSALKNKQDLMKFL

SEQ ID NO: 1169 - protein, 36 aa, Lactobacillus paracasei subsp. paracasei CNCM I-4649
WGKVGAAGVGCGLITWWTGPGAVADGALCAATQFFG

SEQ ID NO: 1170 - protein, 37 aa, Firmicutes bacterium CAG:56
KMTAYAQEAGDPAVKQFFQKSAQSAMQCKQQLMTFLQ

SEQ ID NO: 1171 - protein, 34 aa, Lactobacillus casei 5b
DFWRGVGKELGIIWAAAGDAGYCRAHKYGGPGHC

SEQ ID NO: 1172 - protein, 34 aa, Lactobacillus paracasei NRIC 0644; identical to SEQ ID NO: 1171

SEQ ID NO: 1173 - protein, 34 aa, Lactobacillus paracasei subsp. paracasei Lpp49
DFWRGVGKELSIIWAAAGDAGYCRAHKYGGPGHC

SEQ ID NO: 1174 - protein, 34 aa, Lactobacillus paracasei subsp. tolerans Lpl7; identical to SEQ ID NO: 1171

SEQ ID NO: 1175 - protein, 34 aa, Lactobacillus paracasei subsp. paracasei 8700:2; identical to SEQ ID NO: 1171

SEQ ID NO: 1176 - protein, 34 aa, Lactobacillus casei; identical to SEQ ID NO: 1171

SEQ ID NO: 1177 - protein, 34 aa, Lactobacillus paracasei subsp. paracasei CNCM I-4649; identical to SEQ ID NO: 1171

SEQ ID NO: 1178 - protein, 34 aa, Lactobacillus paracasei subsp. paracasei Lpp74; identical to SEQ ID NO: 1171

SEQ ID NO: 1179 - protein, 34 aa, Lactobacillus paracasei subsp. paracasei CNCM I-4270; identical to SEQ ID NO: 1171

SEQ ID NO: 1180 - protein, 34 aa, Lactobacillus paracasei subsp. paracasei Lpp123; identical to SEQ ID NO: 1171

SEQ ID NO: 1181 - protein, 34 aa, Lactobacillus paracasei NRIC 1981; identical to SEQ ID NO: 1171

SEQ ID NO: 1182 - protein, 11 aa, Streptococcus equi subsp. zooepidemicus CY
KVVKWVAGFFE

SEQ ID NO: 1183 - protein, 16 aa, Streptococcus equi subsp. zooepidemicus Sz16
NGLTGGNAGWHSGGII

SEQ ID NO: 1184 - protein, 16 aa, Streptococcus equi subsp. zooepidemicus Sz4is
NGLTGGNAGWHSGGII

SEQ ID NO: 1185 - protein, 11 aa, Streptococcus equi subsp. zooepidemicus Sz4is
KVVKWVAGFFE

SEQ ID NO: 1186 - protein, 11 aa, Streptococcus equi subsp. zooepidemicus SzAM60
KVVKWVAGFFE

SEQ ID NO: 1187 - protein, 11 aa, Streptococcus equi subsp. zooepidemicus Sz16
KVVKWVAGFFE

SEQ ID NO: 1188 - protein, 12 aa, Leuconostoc carnosum
NGLTGGNAGWHN

SEQ ID NO: 1189 - protein, 11 aa, Streptococcus equi subsp. zooepidemicus (strain H70)
KVVKWVAGFFE

SEQ ID NO: 1190 - protein, 11 aa, Streptococcus equi subsp. zooepidemicus (strain MGCS10565)
KVVKWVAGFFE

SEQ ID NO: 1191 - protein, 17 aa, Fulvivirga imtechensis AK7
GAVGGGLTGAATFCQEK

SEQ ID NO: 1192 - protein, 24 aa, Enterococcus faecium EnGen0263
AKQCLQAIGSWGIAGTQGVPLELS

SEQ ID NO: 1193 - protein, 29 aa, Clostridium sp. CAG:914
WALLASLASAVVFFIGAFTGYTNPTKCNN

SEQ ID NO: 1194 - protein, 17 aa, Firmicutes bacterium CAG:321
AFVSGILNGIANPKKCN

SEQ ID NO: 1195 - protein, 37 aa, Mycoplasma sp. CAG:776
LHNINGGISAAGILGGIAIAITFIASVIYGYFYPKEN

SEQ ID NO: 1196 - protein, 38 aa, Xylella fastidiosa MUL0034
FLGAFAGAGGLICAAWGGGWMVGKFIHHRLVSDYPTIF

SEQ ID NO: 1197 - protein, 32 aa, Neisseria wadsworthii 9715
LEQVSGGGAAVVVGGIIVVAAIIWWASAQKAH

SEQ ID NO: 1198 - protein, 33 aa, Crinalium epipsammum PCC 9333
EDVLNLIAGGLAIAIFIGGILMMFSTVWTTKKK

SEQ ID NO: 1199 - protein, 18 aa, Streptococcus macedonicus
GAIGTAVGAAAGAIIACR

SEQ ID NO: 1200 - protein, 23 aa, Streptococcus pneumoniae PCS8203
WGAAIGGIGGAVVCGYLAYTATS

SEQ ID NO: 1201 - protein, 23 aa, Streptococcus pneumoniae 2070335
WGAAIGGIGGAVVCGYLAYTATS

SEQ ID NO: 1202 - protein, 23 aa, Streptococcus pneumoniae PCS8106
WGAAIGGIGGAVVCGYLAYTATS

SEQ ID NO: 1203 - protein, 23 aa, Streptococcus pneumoniae PNI0446
WGAAIGGIGGAVVCGYLAYTATS

SEQ ID NO: 1204 - protein, 27 aa, Streptococcus pneumoniae
YGKILGPWGAAIGGAVVCGYLAYTATS

SEQ ID NO: 1205 - protein, 25 aa, Streptococcus pneumoniae
GLWGAAIGGIGGAVVCGYLAYTATS

SEQ ID NO: 1206 - protein, 23 aa, Streptococcus pneumoniae
WGAAIGGIGGAVVCGYLAYTATS

SEQ ID NO: 1207 - protein, 23 aa, Streptococcus pneumoniae
WGAAIGGIGGAVVCGYLAYTATS

SEQ ID NO: 1208 - protein, 23 aa, Streptococcus pneumoniae serotype 4 (strain ATCC BAA-334 / TIGR4)
WGAAIGGIGGAVVCGYLAYTATS

SEQ ID NO: 1209 - protein, 23 aa, Streptococcus pneumoniae SP6-BS73
WGAAIGGIGGAVVCGYLAYTATS

SEQ ID NO: 1210 - protein, 23 aa, Streptococcus pneumoniae (strain CGSP14)
WGAAIGGIGGAVVCGYLAYTATS

SEQ ID NO: 1211 - protein, 25 aa, Streptococcus pneumoniae (strain 70585)
GLWGAAIGGIGGAVVCGYLAYTATS

SEQ ID NO: 1212 - protein, 23 aa, Streptococcus pneumoniae (strain JJA)
WGAAIGGIGGAVVCGYLAYTATS

SEQ ID NO: 1213 - protein, 23 aa, Streptococcus pneumoniae GA47502
WGAAIGGIGGAVVCGYLAYTATS

SEQ ID NO: 1214 - protein, 23 aa, Streptococcus pneumoniae GA41410
WGAAIGGIGGAVVCGYLAYTATS

SEQ ID NO: 1215 - protein, 19 aa, Simonsiella muelleri ATCC 29453
WDKVGAGLGAVGIGLALYY

SEQ ID NO: 1216 - protein, 16 aa, Enterococcus faecium EnGen0263
VAGGLVGAGQDWISQK

SEQ ID NO: 1217 - protein, 40 aa, Bacillus azotoformans LMG 9581
VAKKLETYAQNCADPELKEILQRDAQAAKQSQQQLMTFLG

SEQ ID NO: 1218 - protein, 12 aa, Clostridium cellulovorans (strain ATCC 35296 / DSM 3052 / OCM 3 / 743B)
GGYTHGGGGGRH

SEQ ID NO: 1219 - protein, 24 aa, Leptospira interrogans serovar Icterohaemorrhagiae str. Verdun HP
LSLLTGGLSDLIEGCINNQIRENQ

SEQ ID NO: 1220 - protein, 38 aa, Elizabethkingia miricola (Chryseobacterium miricola)
SFFGRAWKWIKEHVGIFDYGETLETSGSAIGVKVGVDL

SEQ ID NO: 1221 - protein, 21 aa, Lactobacillus sp. ASF360
EFGKGFLNSFAASHNNMEGDN

SEQ ID NO: 1222 - protein, 18 aa, Mariniradius saccharolyticus AK6
QICREVYGTGGHCTAATP

SEQ ID NO: 1223 - protein, 36 aa, Rhodonellum psychrophilum GCM71 = DSM 17998
CEDGAQFGGSGNCPIDASLECANNGGAAYSVETGCS

SEQ ID NO: 1224 - protein, 22 aa, Fulvivirga imtechensis AK7
LMGTVYTFIEKAPFPRLGWTLL

SEQ ID NO: 1225 - protein, 17 aa, Streptococcus sp. I-G2
SVFNAGYKFGADLARRH

SEQ ID NO: 1226 - protein, 29 aa, Streptococcus equi subsp. equi
GGDWWSEILNFNRSQKYKHTSVGSNNIIV

SEQ ID NO: 1227 - protein, 29 aa, Streptococcus equi subsp. equi (strain 4047)
GGDWWSEILNFNRSQKYKHTSVGSNNIIV

SEQ ID NO: 1228 - protein, 29 aa, Streptococcus equi subsp. zooepidemicus (strain H70)
GGDWWSEILNFNRSQKYKHTSVGSNNIIV

SEQ ID NO: 1229 - protein, 29 aa, Streptococcus equi subsp. zooepidemicus (strain MGCS10565)
GGDWWSEILNFNRSQKYKHTSVGSNNIIV

SEQ ID NO: 1230 - protein, 29 aa, Streptococcus equi subsp. zooepidemicus Sz4is
GGDWWSEILNFNRSQKYKHTSVGSNNIIV

SEQ ID NO: 1231 - protein, 31 aa, bacterium YEK0313
AVIGGAVGAVAGAVGGVFVKDDPKVGIHVMY

SEQ ID NO: 1232 - protein, 23 aa, Actinoplanes sp. N902-109
ANHANGLFRRVLVGRMTGAGQVG

SEQ ID NO: 1233 - protein, 32 aa, Streptococcus intermedius B196; identical to SEQ ID NO: 925

SEQ ID NO: 1234 - protein, 30 aa, Streptococcus pneumoniae
TGGGWWKDLLHRFNVIEQNNTKGFNQPIQL

SEQ ID NO: 1235 - protein, 37 aa, Prochlorococcus sp. MIT 0701
VSGGIGPLAAIALVKLGGAAVAGVGFAIAYGASKLRK

SEQ ID NO: 1236 - protein, 17 aa, Streptococcus pneumoniae GA44500
GYIGGGNHLCKGSAARF

SEQ ID NO: 1237 - protein, 17 aa, Streptococcus pneumoniae SP14-BS69
GYIGGGNHLCKGSAARF

SEQ ID NO: 1238 - protein, 17 aa, Streptococcus pneumoniae
GYIGGGNHLCKGSAARF

SEQ ID NO: 1239 - protein, 17 aa, Streptococcus pneumoniae
GYIGGGNHLCKGSAARF

SEQ ID NO: 1240 - protein, 42 aa, Bacillus cereus BAG2O-2
ATIINKLEQYAQTCTDPELKQMLQKDAQDARNTKQQLMTFLG

SEQ ID NO: 1241 - protein, 42 aa, Bacillus cereus HuB5-5; identical to SEQ ID NO: 1240

SEQ ID NO: 1242 - protein, 42 aa, Bacillus sp. LK2
ATIINKLEQYAQVCTDPQLKQMLEKDAQDARNTKQQLMTFLG

SEQ ID NO: 1243 - protein, 42 aa, Bacillus cereus HuB2-9; identical to SEQ ID NO: 1240

SEQ ID NO: 1244 - protein, 42 aa, Bacillus cereus BAG1O-2; identical to SEQ ID NO: 1240

SEQ ID NO: 1245 - protein, 42 aa, Bacillus cereus VD214; identical to SEQ ID NO: 1240

SEQ ID NO: 1246 - protein, 42 aa, Bacillus cereus Rock3-28; identical to SEQ ID NO: 1240

SEQ ID NO: 1247 - protein, 42 aa, Bacillus mycoides
ATIINKLEQYAQACTDPQLKQMLEKDAQDARNTKQQLMTFLG

SEQ ID NO: 1248 - protein, 18 aa, Streptococcus pneumoniae serotype 4 (strain ATCC BAA-334 / TIGR4)
SGYIGGGNHLCKGSAARF

SEQ ID NO: 1249 - protein, 42 aa, Bacillus toyonensis BCT-7112; identical to SEQ ID NO: 1240

SEQ ID NO: 1250 - protein, 42 aa, Bacillus cereus VD107; identical to SEQ ID NO: 1247

SEQ ID NO: 1251 - protein, 42 aa, Bacillus cereus HuB4-10; identical to SEQ ID NO: 1240

SEQ ID NO: 1252 - protein, 12 aa, Clostridium botulinum (strain Langeland / NCTC 10281 / Type F)
TGFYNGYRNAGR

SEQ ID NO: 1253 - protein, 42 aa, Bacillus cereus VD131; identical to SEQ ID NO: 1240

SEQ ID NO: 1254 - protein, 42 aa, Bacillus cereus Rock4-18; identical to SEQ ID NO: 1240

SEQ ID NO: 1255 - protein, 42 aa, Bacillus cereus Rock3-29; identical to SEQ ID NO: 1240

SEQ ID NO: 1256 - protein, 42 aa, Bacillus cereus HuA2-1; identical to SEQ ID NO: 1247

SEQ ID NO: 1257 - protein, 42 aa, Bacillus cereus HuA2-9; identical to SEQ ID NO: 1247

SEQ ID NO: 1258 - protein, 42 aa, Bacillus cereus VD115; identical to SEQ ID NO: 1240

SEQ ID NO: 1259 - protein, 42 aa, Bacillus cereus BAG6O-1; identical to SEQ ID NO: 1240

SEQ ID NO: 1260 - protein, 42 aa, Bacillus cereus VD148; identical to SEQ ID NO: 1240

SEQ ID NO: 1261 - protein, 42 aa, Bacillus cereus HuA2-3; identical to SEQ ID NO: 1240

SEQ ID NO: 1262 - protein, 42 aa, Bacillus cereus VD142; identical to SEQ ID NO: 1247

SEQ ID NO: 1263 - protein, 42 aa, Bacillus thuringiensis MC28; identical to SEQ ID NO: 1240

SEQ ID NO: 1264 - protein, 42 aa, Bacillus cereus BAG4X2-1; identical to SEQ ID NO: 1240

SEQ ID NO: 1265 - protein, 42 aa, Bacillus cereus BAG5O-1; identical to SEQ ID NO: 1240

SEQ ID NO: 1266 - protein, 17 aa, Streptococcus pneumoniae (strain JJA)
GYIGGGNHLCKGSAARF

SEQ ID NO: 1267 - protein, 17 aa, Streptococcus pneumoniae PCS8203
GYIGGGNHLCKGSAARF

SEQ ID NO: 1268 - protein, 17 aa, Streptococcus pneumoniae (strain ATCC BAA-255 / R6)
GYIGGGNHLCKGSAARF

SEQ ID NO: 1269 - protein, 17 aa, Streptococcus pneumoniae (strain 70585)
GYIGGGNHLCKGSAARF

SEQ ID NO: 1270 - protein, 17 aa, Streptococcus pneumoniae serotype A19 (strain TCH8431)
GYIGGGNHLCKGSAARF

SEQ ID NO: 1271 - protein, 17 aa, Streptococcus pneumoniae SP6-BS73
GYIGGGNHLCKGSAARF

SEQ ID NO: 1272 - protein, 17 aa, Streptococcus pneumoniae PCS8106
GYIGGGNHLCKGSAARF

SEQ ID NO: 1273 - protein, 17 aa, Streptococcus pneumoniae PNI0446
GYIGGGNHLCKGSAARF

SEQ ID NO: 1274 - protein, 27 aa, Mycobacterium ulcerans str. Harvey
AAGWKACSSIYGMPFVDCQRSSGPCSR

SEQ ID NO: 1275 - protein, 15 aa, Streptococcus equi subsp. zooepidemicus Sz4is
GGLGGAVAYGATCWW

SEQ ID NO: 1276 - protein, 17 aa, Streptococcus mitis 27/7
GYIGGGNHLCKGSAARF

SEQ ID NO: 1277 - protein, 17 aa, Streptococcus mitis
GYIGGGNHLCKGSAARF

SEQ ID NO: 1278 - protein, 17 aa, Streptococcus pseudopneumoniae 5247
GYIGGGNHLCKGSPARF

SEQ ID NO: 1279 - protein, 17 aa, Streptococcus sp. oral taxon 071 str. 73H25AP
GYIGGGNHLCKGSAARF

SEQ ID NO: 1280 - protein, 21 aa, Dorea sp. CAG:317
KLFQDAADSAMKNKQDLMRFL

SEQ ID NO: 1281 - protein, 42 aa, Bacillus cereus MC67
ATIINKLDQYAQACTDPELKQMLQKDAQDARNTKQQLMTFLG

SEQ ID NO: 1282 - protein, 42 aa, Bacillus mycoides; identical to SEQ ID NO: 1281

SEQ ID NO: 1283 - protein, 42 aa, Bacillus cereus VD118; identical to SEQ ID NO: 1281

SEQ ID NO: 1284 - protein, 42 aa, Bacillus cereus VDM034; identical to SEQ ID NO: 1281

SEQ ID NO: 1285 - protein, 42 aa, Bacillus cereus BAG6X1-2; identical to SEQ ID NO: 1281

SEQ ID NO: 1286 - protein, 42 aa, Bacillus cereus VDM062; identical to SEQ ID NO: 1281

SEQ ID NO: 1287 - protein, 42 aa, Bacillus cereus BAG6O-2; identical to SEQ ID NO: 1281

SEQ ID NO: 1288 - protein, 42 aa, Bacillus cereus MC118; identical to SEQ ID NO: 1281

SEQ ID NO: 1289 - protein, 42 aa, Bacillus cereus BAG5X1-1; identical to SEQ ID NO: 1281

SEQ ID NO: 1290 - protein, 36 aa, Blautia sp. CAG:257
MQDYAQKAEDMEVKQFFQKSAQSAQQTKQQLMQFLQ

SEQ ID NO: 1291 - protein, 42 aa, Streptococcus dysgalactiae subsp. equisimilis RE378
IIGGLGGLASGLKFCKLPHLVLTGECVVGFTVGGAYLGYTAN

SEQ ID NO: 1292 - protein, 36 aa, Ruminococcus sp. CAG:60
MDEYARQATDAQVKQFFQKSAQSAADCKNQLMQYLQ

SEQ ID NO: 1293 - protein, 21 aa, Streptococcus mitis SK579
SITNFWKKYFNHDSSTVNRRH

SEQ ID NO: 1294 - protein, 21 aa, Streptococcus mitis SK616
SITNFWKKYFNHDSSTVNRRH

SEQ ID NO: 1295 - protein, 20 aa, Bradyrhizobium sp. S23321
AVASLLGGGGHINITIHRQN

SEQ ID NO: 1296 - protein, 25 aa, Clostridium nexile CAG:348
AEIKKLFQDAADSAMKNKQDLMKFL

SEQ ID NO: 1297 - protein, 21 aa, Coprococcus sp. HPP0074
KLFQDAADSAMKNKQELMRFL

SEQ ID NO: 1298 - protein, 21 aa, Lachnospiraceae bacterium 9_1_43BFAA
KLFQDAADSAMKNKQELMRFL

SEQ ID NO: 1299 - protein, 21 aa, Lachnospiraceae bacterium 6_1_37FAA
KLFQDAADSAMKNKQELMRFL

SEQ ID NO: 1300 - protein, 25 aa, Tyzzerella nexilis DSM 1787
AEIKKLFQDAADSAMKNKQDLMKFL

SEQ ID NO: 1301 - protein, 21 aa, Coprococcus sp. HPP0048
KLFQDAADSAMKNKQELMRFL

SEQ ID NO: 1302 - protein, 13 aa, Streptococcus vestibularis ATCC 49124
VINEFVKGFHHAW

SEQ ID NO: 1303 - protein, 13 aa, Streptococcus vestibularis F0396
VINEFVKGFHHAW

SEQ ID NO: 1304 - protein, 26 aa, Streptococcus intermedius BA1
GWLEDLLKHFSGYNSLTKGDSNNTLG

SEQ ID NO: 1305 - protein, 42 aa, Bacillus subtilis subsp. natto (strain BEST195)
AGAAAGAAVMGGTAIALGAAAGPVGFAAGVGMAILTRPGHAR

SEQ ID NO: 1306 - protein, 26 aa, Streptococcus intermedius B196
GWLEDLLKHFSGYNSLTKGDSNNTLG

SEQ ID NO: 1307 - protein, 33 aa, Herbaspirillum sp. YR522
AGFVEWLRQLFTPAVPDEPDRWVHEELNHNAQY

SEQ ID NO: 1308 - protein, 34 aa, Lactobacillus casei W56; identical to SEQ ID NO: 1173

SEQ ID NO: 1309 - protein, 24 aa, Leuconostoc mesenteroides subsp. mesenteroides (strain ATCC 8293 / NCDO 523)
WAGAGAAGFSGGIAVGLNRVNRNN

SEQ ID NO: 1310 - protein, 33 aa, Lactococcus lactis
GQTAQQVVNQLNGVTGFHAYNHNPYGSGGTPND

SEQ ID NO: 1311 - protein, 33 aa, Lactococcus lactis subsp. cremoris (strain SK11); identical to SEQ ID NO: 1310

SEQ ID NO: 1312 - protein, 20 aa, Paenibacillus polymyxa (strain SC2) (Bacillus polymyxa)
KTFKEIVSRIEQRIRQNESL

SEQ ID NO: 1313 - protein, 19 aa, Streptococcus infantarius (strain CJ18)
HLLAGLWDWFKRHDPYKQA

SEQ ID NO: 1314 - protein, 19 aa, Streptococcus infantarius subsp. infantarius ATCC BAA-102
HLLAGLWDWFKRHDPYKQA

SEQ ID NO: 1315 - protein, 19 aa, Streptococcus infantarius subsp. infantarius
HLLAGLWDWFKRHDPYKQA

SEQ ID NO: 1316 - protein, 21 aa, [Clostridium] scindens ATCC 35704
KLFQDAAQSAMKNKQDLMKFL

SEQ ID NO: 1317 - protein, 21 aa, Lachnospiraceae bacterium 5_1_57FAA
KLFQDAAQSAMKNKQDLMKFL

SEQ ID NO: 1318 - protein, 22 aa, Streptococcus mitis (strain B6)
SLATEWSTILTHATRRGSGIGY

SEQ ID NO: 1319 - protein, 17 aa, Pseudomonas sp. P482
FDLYRGGAHQGSYTLCK

SEQ ID NO: 1320 - protein, 29 aa, Caldicellulosiruptor kristjanssonii (strain ATCC 700853 / DSM 12137 / I77R1B)
TLVKELYEFAKELYDFGRGFIKGWQDATR

SEQ ID NO: 1321 - protein, 42 aa, Ruminococcus sp. 5_1_39BFAA
EELENIAGGFGHPTMDDPRYKEQMRINTMLKRGMKMDEIQKR

SEQ ID NO: 1322 - protein, 40 aa, Prevotella multisaccharivorax DSM 17128
QKGMSQVRGGVQEESLKDDKKLEPDWGNTNYCESTRPVRR

SEQ ID NO: 1323 - protein, 13 aa, Vibrio galatheae
SGPAWLSRYLHKR

SEQ ID NO: 1324 - protein, 22 aa, Sphingobacterium sp. ACCC 05744
QTGPEYGDTFLDGDNDRLQDES

SEQ ID NO: 1325 - protein, 28 aa, Streptococcus sp. I-P16
WKIATAAVGSIGLVFAAGVGLGYLANRP

SEQ ID NO: 1326 - protein, 12 aa, Sphingobacterium sp. ACCC 05744
EVGKSAAERARR

SEQ ID NO: 1327 - protein, 34 aa, Flavihumibacter petaseus NBRC 106054
TLAGELAQLGAKALQSLWELGKMVSDTQSSIAKK

SEQ ID NO: 1328 - protein, 31 aa, Caldicellulosiruptor lactoaceticus 6A
GCWDGYYEAAQKDNSCGSFGGGTSRGYGASR

SEQ ID NO: 1329 - protein, 31 aa, Caldicellulosiruptor kristjanssonii (strain ATCC 700853 / DSM 12137 / I77R1B); identical to SEQ ID NO: 1328

SEQ ID NO: 1330 - protein, 22 aa, [Eubacterium] rectale DSM 17629
KYVKNYLDFIKKAIDIFRPMPI

SEQ ID NO: 1331 - protein, 28 aa, Bacillus sp. JCM 19045
VEKAVQRGVDASRLRDQVEAYMEDERKK

SEQ ID NO: 1332 - protein, 28 aa, Bacillus sp. JCM 19046
VEKAVQRGVDASRLRDQVEAYMEDERKK

SEQ ID NO: 1333 - protein, 21 aa, Dorea longicatena DSM 13814
KLFQDAADSAMKNRQDLMKFL

SEQ ID NO: 1334 - protein, 21 aa, Dorea longicatena CAG:42
KLFQDAADSAMKNRQDLMKFL

SEQ ID NO: 1335 - protein, 39 aa, Faecalibacterium sp. CAG:82
NYIARVFSAGSSIINNVVTIVDTVKKINSFVPDMGSTKK

SEQ ID NO: 1336 - protein, 42 aa, Lysinibacillus manganicus DSM 26584
GNVAKKLEAYAASCTDPELKAILERDAQAAKQAQQDLISYLN

SEQ ID NO: 1337 - protein, 25 aa, Lysobacter dokdonensis DS-58
LAALGGAVFAFGYEVGKDMAARDAR

SEQ ID NO: 1338 - protein, 30 aa, Streptococcus pseudopneumoniae 5247
TGGGWWEELLHETILSKFKITKALELPIQL

SEQ ID NO: 1339 - protein, 30 aa, Streptococcus pneumoniae; identical to SEQ ID NO: 1338

SEQ ID NO: 1340 - protein, 30 aa, Streptococcus pneumoniae (strain ATCC BAA-255 / R6); identical to SEQ ID NO: 1338

SEQ ID NO: 1341 - protein, 30 aa, Streptococcus pneumoniae GA41410; identical to SEQ ID NO: 1338

SEQ ID NO: 1342 - protein, 30 aa, Streptococcus pneumoniae (strain 70585); identical to SEQ ID NO: 1338

SEQ ID NO: 1343 - protein, 30 aa, Streptococcus pneumoniae (strain Hungary19A-6); identical to SEQ ID NO: 1338

SEQ ID NO: 1344 - protein, 30 aa, Streptococcus pneumoniae serotype 2 (strain D39 / NCTC 7466); identical to SEQ ID NO: 1338

SEQ ID NO: 1345 - protein, 28 aa, Bradyrhizobium sp. S23321
KVAEAIIKAITHPPTGPGPGPTVPRRMS

SEQ ID NO: 1346 - protein, 24 aa, Staphylococcus microti
GWAGRIAGKVAGGVRSLADGIANG

SEQ ID NO: 1347 - protein, 41 aa, Fulvivirga imtechensis AK7
GGEPVSDGYEEVYYDQGGVTHVYHCRNGNCVYIRSMEGMIA

SEQ ID NO: 1348 - protein, 21 aa, Ruminococcus lactaris CC59_002D
KLFQDAADSAMKNKQELMKFL

SEQ ID NO: 1349 - protein, 21 aa, Ruminococcus lactaris ATCC 29176
KLFQDAADSAMKNKQELMKFL

SEQ ID NO: 1350 - protein, 17 aa, Streptococcus pneumoniae
GYIGGGNHLCKGSAARF

SEQ ID NO: 1351 - protein, 32 aa, Tannerella forsythia (strain ATCC 43037 / JCM 10827 / FDC 338) (Bacteroides forsythus)
RNGARIAGRLVGIALMGPLGGIYYCGKDMGWW

SEQ ID NO: 1352 - protein, 32 aa, Tannerella forsythia KS16; identical to SEQ ID NO: 1351

SEQ ID NO: 1353 - protein, 30 aa, Sphingobacterium paucimobilis HER1398
GVIGRLIKAAANATIAMAEDLIDRWRGPNA

SEQ ID NO: 1354 - protein, 25 aa, Pseudomonas sp. CFII64
KYLSSVIAEMTGLEPAVGIITLTYQ

SEQ ID NO: 1355 - protein, 25 aa, Pseudomonas syringae
KYLSSVIAEMTGLEPAVGIITLTYQ

SEQ ID NO: 1356 - protein, 21 aa, Lachnospiraceae bacterium M18-1
KLFQDAADSAMKNKQTLMKFL

SEQ ID NO: 1357 - protein, 27 aa, Bacteroides sp. 3_1_33FAA
GRELGHKIGKAFYGACAMYGVYVLFCL

SEQ ID NO: 1358 - protein, 30 aa, Streptococcus mitis
TGGGWWEDFLHEISLSKFKITKALELPIQL

SEQ ID NO: 1359 - protein, 25 aa, Algoriphagus machipongonensis
NAVNAMVAFADGVKEGVQAIKDLKS

SEQ ID NO: 1360 - protein, 17 aa, Streptococcus pneumoniae
GYIGGGNHLCKGSAARF

SEQ ID NO: 1361 - protein, 21 aa, Clostridium sp. D5
KLFQDAADSAMKNKQELMKFL

SEQ ID NO: 1362 - protein, 22 aa, Lachnospiraceae bacterium 1_4_56FAA
KLFQDAADSAMKNKQDLMKFLS

SEQ ID NO: 1363 - protein, 22 aa, Lachnospiraceae bacterium CAG:215
KLFQDAADSAMKNKQDLMKFLS

SEQ ID NO: 1364 - protein, 13 aa, Streptococcus sp. ACS2
VINEFVKGFRQAW

SEQ ID NO: 1365 - protein, 13 aa, Streptococcus salivarius
VINEFVKGFRQAW

SEQ ID NO: 1366 - protein, 22 aa, Aquimarina atlantica
AAIGGLYKAGEAIGKGLYHLFN

SEQ ID NO: 1367 - protein, 18 aa, Streptococcus oralis SK255
SAFGAGYKFGSDLARRGR

SEQ ID NO: 1368 - protein, 29 aa, Flavobacterium sp. F52
GAAAVVTTGGAALFAASFILGSIGTARSC

SEQ ID NO: 1369 - protein, 29 aa, Flavobacterium sp. KMS
ALTGLAAGVAAGLNPLVGGLATAACFLLN

SEQ ID NO: 1370 - protein, 29 aa, Streptococcus sp. oral taxon 056 str. F0418
IADKFVDAFGDYSTNSCRKNHRQWFCIQV

SEQ ID NO: 1371 - protein, 36 aa, Lactobacillus casei
GLGAIARSWAQGGFVAPAMSLSIDVLNELKRKENLP

SEQ ID NO: 1372 - protein, 36 aa, Lactobacillus casei subsp. casei ATCC 393
GLGAIARSWAQGGFATPAMSLGIDVLNELKRKENLP

SEQ ID NO: 1373 - protein, 38 aa, Burkholderia grimmiae
AGGRAVSAIVDGRAPGTVDDWGINIAIFEGRISGPYIV

SEQ ID NO: 1374 - protein, 42 aa, Bacillus cereus Rock3-28
RAIVNLIGNGIATVVVAKSENEFDDEKYKRVVEEMKREKIAG

SEQ ID NO: 1375 - protein, 42 aa, Bacillus toyonensis BCT-7112; identical to SEQ ID NO: 1374

SEQ ID NO: 1376 - protein, 42 aa, Bacillus cereus Rock4-18; identical to SEQ ID NO: 1374

SEQ ID NO: 1377 - protein, 42 aa, Bacillus cereus Rock3-29; identical to SEQ ID NO: 1374

SEQ ID NO: 1378 - protein, 42 aa, Streptococcus sp. DORA_10
LSGAAGAVEAAMSCAPAGPYVIAACAVGGAIYGGFWGYVFGS

SEQ ID NO: 1379 - protein, 42 aa, Streptococcus mitis; identical to SEQ ID NO: 1378

SEQ ID NO: 1380 - protein, 27 aa, Butyrivibrio fibrisolvens
GGGNGVIKTISHECHMNTWQFIFTCCS

SEQ ID NO: 1381 - protein, 40 aa, Oceanobacillus picturae
IANKLEAYAQNCTDPQLVSILQQDAQDAKAAQQKLMTFLG

SEQ ID NO: 1382 - protein, 25 aa, Clostridium sp. CAG:1000
GIVGTLITFFAGVVDGYLRPLKCEE

SEQ ID NO: 1383 - protein, 28 aa, Caldicellulosiruptor bescii (strain ATCC BAA-1888 / DSM 6725 / Z-1320) (Anaerocellum thermophilum)
GFWDGYYEVAQRDSSFGGGSSRGHGATR

SEQ ID NO: 1384 - protein, 18 aa, Xylella fastidiosa subsp. sandyi Ann-1
DAFNSFMKGFNQGYNKKS

SEQ ID NO: 1385 - protein, 36 aa, Lactobacillus casei; identical to SEQ ID NO: 1371

SEQ ID NO: 1386 - protein, 22 aa, Streptococcus sp. M143
SLATEWSTILTHATRRAYGIGY

SEQ ID NO: 1387 - protein, 24 aa, Clostridium perfringens F262
CAKLAGAGITAGIAVAGIYYSQKK

SEQ ID NO: 1388 - protein, 27 aa, Indibacter alkaliphilus LW1
VGAGFKAALDGVFVYQWYKKLKENGWI

SEQ ID NO: 1389 - protein, 25 aa, Streptococcus pseudopneumoniae 22725
GVLNAAVQIFNAGYKFGSDFARRGR

SEQ ID NO: 1390 - protein, 25 aa, Streptococcus pseudopneumoniae 5247
GVLNAAVQIFNAGYKFGSDFARRGR

SEQ ID NO: 1391 - protein, 25 aa, Streptococcus mitis SK1073
GVLNAAVQIFNAGYKFGSDFARRGR

SEQ ID NO: 1392 - protein, 25 aa, Streptococcus mitis SK575
GVLNAAVQIFNAGYKFGSDLARRGR

SEQ ID NO: 1393 - protein, 25 aa, Streptococcus sp. M143
GVLNAAVQIFNAGYKFGSDLARRGR

SEQ ID NO: 1394 - protein, 25 aa, Streptococcus mitis bv. 2 str. SK95
GVLNAAVQIFNAGYKFGSDFARRGR

SEQ ID NO: 1395 - protein, 25 aa, Streptococcus mitis
GVLNAAVQIFSAGYKFGSDLARRGR

SEQ ID NO: 1396 - protein, 25 aa, Streptococcus mitis
GVLNAAVQIFNAGYKFGSDFARRGR

SEQ ID NO: 1397 - protein, 25 aa, Streptococcus pseudopneumoniae (strain IS7493)
GVLNAAVQIFNAGYKFGSDFARRGR

SEQ ID NO: 1398 - protein, 37 aa, Faecalibacterium cf. prausnitzii KLE1255
KVFNAIARIFSGASSIINNVNVIYQSFLTLGDLLKSF

SEQ ID NO: 1399 - protein, 25 aa, Streptococcus mitis
GVLNAAVQIFNAGYKFGSDLARRGR

SEQ ID NO: 1400 - protein, 25 aa, Streptococcus mitis
GVLNAAVQIFNAGYKFGSDFARRGR

SEQ ID NO: 1401 - protein, 16 aa, Bradyrhizobium sp. LTSPM299
NVLNGMLGAIGRPPIT

SEQ ID NO: 1402 - protein, 17 aa, Streptococcus australis ATCC 700641
SVFNAGYKFGADLARRH

SEQ ID NO: 1403 - protein, 15 aa, Lactobacillus casei LOCK919
GLVDGFIGIFRGLGH

SEQ ID NO: 1404 - protein, 15 aa, Amphibacillus xylanus (strain ATCC 51415 / DSM 6626 / JCM 7361 / LMG 17667 / NBRC 15112 / Ep01)
AAGAAVGIAAGAAAN

SEQ ID NO: 1405 - protein, 36 aa, Streptococcus sp. oral taxon 056 str. F0418
WGVFKSVIGTFGPSAPHPEACIPKSSWNPVPPVPCP

SEQ ID NO: 1406 - protein, 34 aa, Cylindrospermum stagnale PCC 7417
EDVATVIQSLDDQIQQMTINLNETSAKLRSQLGI

SEQ ID NO: 1407 - protein, 16 aa, Lactobacillus paracasei subsp. paracasei Lpp14
SGAKTGWEIANKYKIY

SEQ ID NO: 1408 - protein, 39 aa, Bacteroides vulgatus str. 3975 RP4
EGGSQYCEHLQQMTRGEEAQGWSNEKWDEWAEAWDTHCW

SEQ ID NO: 1409 - protein, 14 aa, Streptococcus equi subsp. zooepidemicus Sz4is
GFWGGAATGAATFC

SEQ ID NO: 1410 - protein, 39 aa, Pedobacter sp. NL19
GVIGAVATTVGGVVNTVGTVVGNTVKFGLTQLFTILGSL

SEQ ID NO: 1411 - protein, 41 aa, Lactococcus garvieae
GALGNALNGLGTWANMMNGGGFVNQWQVYANKGKINQYRPY

SEQ ID NO: 1412 - protein, 36 aa, Faecalibacterium prausnitzii SL3/3
NYIARIFSGASSIINNVNVIYQSFVSLNSLLGSFGK

SEQ ID NO: 1413 - protein, 36 aa, Faecalibacterium prausnitzii M21/2; identical to SEQ ID NO: 1412

SEQ ID NO: 1414 - protein, 29 aa, Capnocytophaga sp. oral taxon 380 str. F0488
AVATGGIGLYAAAVGFAVAPASWGYSCFT

SEQ ID NO: 1415 - protein, 36 aa, Psychroflexus gondwanensis ACAM 44
AGGAIFGGIAGLGVGALLGGYGAGVMITICCDEMNN

SEQ ID NO: 1416 - protein, 22 aa, Streptococcus agalactiae
GGGWIDGIKKIINLDKLNFLKL

SEQ ID NO: 1417 - protein, 17 aa, Lactococcus raffinolactis 4877
GVTAVAAGLGIGYLVNR

SEQ ID NO: 1418 - protein, 21 aa, Streptococcus pseudopneumoniae 5247
GIFEDAVKWCDKLFSTGRHFA

SEQ ID NO: 1419 - protein, 12 aa, Rhodopirellula islandica
GEGMDPVAGGFA

SEQ ID NO: 1420 - protein, 13 aa, Vibrio orientalis CIP 102891 = ATCC 33934
NGPAWLNRYLTKR

SEQ ID NO: 1421 - protein, 29 aa, Vibrio cholerae
LVSGGIALGSRCGYPLFADGEFYVTHRDC

SEQ ID NO: 1422 - protein, 12 aa, Pandoraea vervacti
GKDGIAGGKSVL

SEQ ID NO: 1423 - protein, 38 aa, Clostridium perfringens E str. JGS1987
AGYGAAFGTAFGPGVGTAVGAAVGLGLGAVGIIGCGGN

SEQ ID NO: 1424 - protein, 17 aa, Streptococcus sp. C150
NWGTQGHAGWHTGGVAP

SEQ ID NO: 1425 - protein, 35 aa, Escherichia coli MS 85-1
QFVAGGIGAAAGGVAGGAIYDYGGTAEFGKNRTLS

SEQ ID NO: 1426 - protein, 35 aa, Escherichia coli MS 84-1; identical to SEQ ID NO: 1425

SEQ ID NO: 1427 - protein, 16 aa, Lactobacillus casei 5b
GGATSGWSLADKSHSL

SEQ ID NO: 1428 - protein, 16 aa, Lactobacillus paracasei subsp. paracasei Lpp225
GGATSGWSLADKSHSL

SEQ ID NO: 1429 - protein, 16 aa, Lactobacillus casei M36
GGATSGWSLADKSHSL

SEQ ID NO: 1430 - protein, 16 aa, Lactobacillus casei 21/1
GGATSGWSLADKSHSL

SEQ ID NO: 1431 - protein, 16 aa, Lactobacillus paracasei subsp. paracasei Lpp126
GGATSGWSLADKSHSL

SEQ ID NO: 1432 - protein, 16 aa, Lactobacillus casei UCD174
GGATSGWSLADKSHSL

SEQ ID NO: 1433 - protein, 16 aa, Lactobacillus casei 32G
GGATSGWSLADKSHSL

SEQ ID NO: 1434 - protein, 16 aa, Lactobacillus casei A2-362
GGATSGWSLADKSHSL

SEQ ID NO: 1435 - protein, 16 aa, Lactobacillus paracasei subsp. paracasei 8700:2
GGATSGWSLADKSHSL

SEQ ID NO: 1436 - protein, 16 aa, Lactobacillus paracasei subsp. paracasei CNCM I-4649
GGATSGWSLADKSHSL

SEQ ID NO: 1437 - protein, 16 aa, Lactobacillus paracasei subsp. paracasei Lpp74
GGATSGWSLADKSHSL

SEQ ID NO: 1438 - protein, 16 aa, Lactobacillus paracasei subsp. paracasei Lpp123
GGATSGWSLADKSHSL

SEQ ID NO: 1439 - protein, 29 aa, Caldicellulosiruptor obsidiansis (strain ATCC BAA-2073 / strain OB47)
AVFGSAAGPVGSLVGAIIGGGVYWLIDQF

SEQ ID NO: 1440 - protein, 16 aa, Lactobacillus paracasei NRIC 1981
GGATSGWSLADKSHSL

SEQ ID NO: 1441 - protein, 16 aa, Lactobacillus casei (strain ATCC 334)
GGATSGWSLADKSHSL

SEQ ID NO: 1442 - protein, 18 aa, Leuconostoc kimchii (strain IMSNU 11154 / KCTC 2386 / IH25)
GGDVVKTLTRLFNQKYLW

SEQ ID NO: 1443 - protein, 30 aa, Neisseria wadsworthii 9715
DALSEAGKNIRDDWREIRDDWREIREILKD

SEQ ID NO: 1444 - protein, 24 aa, Streptococcus sobrinus W1703
NILHSIGNAFSSAYHGLVDGWNNH

SEQ ID NO: 1445 - protein, 26 aa, Streptococcus thermophilus JIM 8232
DYINGFLKGFGGQRTLPTKDYNIPQA

SEQ ID NO: 1446 - protein, 26 aa, Streptococcus thermophilus TH1435
DYINGFLKGFGGQRTLPTKDYNIPQA

SEQ ID NO: 1447 - protein, 26 aa, Streptococcus thermophilus M17PTZA496
DYINGFLKGFGGQRTLPTKDYNIPQA

SEQ ID NO: 1448 - protein, 26 aa, Streptococcus thermophilus TH1477
DYINGFLKGFGGQRTLPTKDYNIPQA

SEQ ID NO: 1449 - protein, 26 aa, Streptococcus thermophilus CAG:236
DYINGFLKGFGGQRTLPTKDYNIPQV

SEQ ID NO: 1450 - protein, 26 aa, Streptococcus thermophilus (strain ATCC BAA-250 / LMG 18311)
DYINGFLKGFGGQRTLPTKDYNIPQV

SEQ ID NO: 1451 - protein, 19 aa, Leuconostoc mesenteroides subsp. mesenteroides (strain ATCC 8293 / NCDO 523)
VLAGGGGFAAGYGLSRWLG

SEQ ID NO: 1452 - protein, 18 aa, Prevotella multisaccharivorax DSM 17128
IDSFKKGADKANREWDNK

SEQ ID NO: 1453 - protein, 14 aa, Mycoplasma ovis str. Michigan
TDAGEVGTRGEATA

SEQ ID NO: 1454 - protein, 42 aa, Bacillus thuringiensis MC28
RAIVNLIGDGIATVVVAKSENEFDDEKYKRVVEEMKREKIAG

SEQ ID NO: 1455 - protein, 32 aa, Roseburia sp. CAG:380
LEDLEQVAGGYSLREKKKVETTAISDDTISRI

SEQ ID NO: 1456 - protein, 25 aa, Clostridium sp. CAG:632
QIKSFFEDAVTSSMDNKQTLMKFLQ

SEQ ID NO: 1457 - protein, 23 aa, Prochlorococcus sp. MIT 0701
YKKVAKKIEDYVDNGPLISVGMM

SEQ ID NO: 1458 - protein, 32 aa, Rheinheimera nanhaiensis E407-8
WSTMSRACGGVGDDEWSTMSDSCKGGEKVIMR

SEQ ID NO: 1459 - protein, 29 aa, Streptococcus agalactiae MRI Z1-217
ELLGGAGHGVNTISAECRWNSLQAIFSCC

SEQ ID NO: 1460 - protein, 29 aa, Streptococcus agalactiae MRI Z1-213
ELLGGAGHGVNTISAECRWNSLQAIFSCC

SEQ ID NO: 1461 - protein, 29 aa, Streptococcus agalactiae MRI Z1-216
ELLGGAGHGVNTISAECRWNSLQAIFSCC

SEQ ID NO: 1462 - protein, 29 aa, Streptococcus dysgalactiae subsp. dysgalactiae ATCC 27957
ELLGGAGHGVNTISAECRWNSLQAIFSCC

SEQ ID NO: 1463 - protein, 29 aa, Streptococcus agalactiae MRI Z1-214
ELLGGAGHGVNTISAECRWNSLQAIFSCC

SEQ ID NO: 1464 - protein, 20 aa, Streptococcus oralis SK313
MGQGALNSYRDAWKYGFRAG

SEQ ID NO: 1465 - protein, 18 aa, Sphingobacterium sp. (strain 21)
EIYDSIVDFVKRGIKALL

SEQ ID NO: 1466 - protein, 15 aa, Lactococcus lactis subsp. lactis A12
SNFSDAYSSFYNATH

SEQ ID NO: 1467 - protein, 35 aa, Moellerella wisconsensis
SPFEEVISHAAKHGSLAELLDMVQTEIAKMAKEAA

SEQ ID NO: 1468 - protein, 23 aa, Clostridium perfringens
ALISAGVTTLAGAAALGFYNGSK

SEQ ID NO: 1469 - protein, 23 aa, Clostridium perfringens E str. JGS1987
ALISAGVTTLAGAAALGFYNGSK

SEQ ID NO: 1470 - protein, 23 aa, Clostridium perfringens B str. ATCC 3626
ALISAGVTTLAGAAALGFYNGSK

SEQ ID NO: 1471 - protein, 23 aa, Clostridium perfringens C str. JGS1495
ALISAGVTTLAGAAALGFYNGSK

SEQ ID NO: 1472 - protein, 36 aa, Methylobacterium sp. (strain 4-46)
LDGVVGGLATYYEMNGNWYIVGHDKSGKATGVVRVT

SEQ ID NO: 1473 - protein, 34 aa, Haliscomenobacter hydrossis (strain ATCC 27775 / DSM 1100 / LMG 10767 / O)
HKVADTYNAIAKTTQESGFMASPVGAGSKGAGGK

SEQ ID NO: 1474 - protein, 32 aa, Firmicutes bacterium CAG:822
GGGYGLWAALGGVITFLISAIEGFLNPIECGK

SEQ ID NO: 1475 - protein, 39 aa, Bacteroides sp. 3_1_33FAA; identical to SEQ ID NO: 1408

SEQ ID NO: 1476 - protein, 38 aa, Bacteroides fragilis str. 2-F-2 #4
YNKMEKILEKLSPEELDSIKGGTWVLTDKGWVWIEGAI

SEQ ID NO: 1477 - protein, 38 aa, Bacteroides fragilis str. S6L5; identical to SEQ ID NO: 1476

SEQ ID NO: 1478 - protein, 38 aa, Bacteroides fragilis CL07T12C05; identical to SEQ ID NO: 1476

SEQ ID NO: 1479 - protein, 38 aa, Bacteroides fragilis str. DS-208; identical to SEQ ID NO: 1476

SEQ ID NO: 1480 - protein, 38 aa, Bacteroides fragilis str. S36L11; identical to SEQ ID NO: 1476

SEQ ID NO: 1481 - protein, 38 aa, Bacteroides fragilis str. 20793-3; identical to SEQ ID NO: 1476

SEQ ID NO: 1482 - protein, 40 aa, Hymenobacter swuensis DY53
DQLGDVVGGGTTNTCNNVPAQELEAIPTIGSCQACSCNGG

SEQ ID NO: 1483 - protein, 39 aa, Hymenobacter swuensis DY53
DQLGDVVGGGTTNTCNGTPPAQELEAIPTINSCQACSCN

SEQ ID NO: 1484 - protein, 38 aa, Paenibacillus popilliae ATCC 14706
ELLRAVVGGVADDEVIKLSQELNVYIVEVQRKLVERES

SEQ ID NO: 1485 - protein, 28 aa, Vibrio brasiliensis LMG 20546
AEAARAISDCQQEGFEGPAWLTRYLNKR

SEQ ID NO: 1486 - protein, 42 aa, Streptococcus mitis SK1073
LAGAAGAVEAAMSCAPAGPYVIAACAVGGAIYGGFWGYVFGS

SEQ ID NO: 1487 - protein, 42 aa, Streptococcus mitis SK616; identical to SEQ ID NO: 1486

SEQ ID NO: 1488 - protein, 27 aa, Bacteroides dorei 5_1_36/D4
GRELGHKIGKAFYGACAMYGVYVLFCL

SEQ ID NO: 1489 - protein, 30 aa, Streptococcus sp. M334
TGGGWWEDLLHEIIFSKFKITKALELPIQL

SEQ ID NO: 1490 - protein, 23 aa, Streptococcus mitis SK575
QGGENWAKTLADWYIGFRRGLGF

SEQ ID NO: 1491 - protein, 23 aa, Streptococcus pseudopneumoniae 22725
QGGESWVKTLADWYIGFRRGFGF

SEQ ID NO: 1492 - protein, 23 aa, Streptococcus pseudopneumoniae 5247
QGGESWVKTLADWYIGFRRGFGF

SEQ ID NO: 1493 - protein, 23 aa, Streptococcus pseudopneumoniae (strain IS7493)
QGGESWVKTLADWYIGFRRGFGF

SEQ ID NO: 1494 - protein, 23 aa, Lactobacillus casei
LATDAFNHADQLIDGFKQGWQRP

SEQ ID NO: 1495 - protein, 27 aa, Bacteroides dorei DSM 17855
GRELGHKIGKAFYGACAMYGVYVLFCL

SEQ ID NO: 1496 - protein, 40 aa, Bacillus cereus VD045
TAAGSIITGVGAAVVFGSGPVGAAVGLAGALILSNPSKVS

SEQ ID NO: 1497 - protein, 40 aa, Bacillus cereus; identical to SEQ ID NO: 1496

SEQ ID NO: 1498 - protein, 23 aa, Streptococcus mitis SK597
QGGENWVKTLADWYIGFRRGFGF

SEQ ID NO: 1499 - protein, 31 aa, Prevotella salivae F0493
TFWEKLIEYIQSIPGYDPMVEYQSRTYEVYM

SEQ ID NO: 1500 - protein, 23 aa, Streptococcus mitis
QGGESWAKTLADWYLGFRRGLGF

SEQ ID NO: 1501 - protein, 27 aa, Bacteroides dorei CL02T12C06
GRELGHKIGKAFYGACAMYGVYVLFCL

SEQ ID NO: 1502 - protein, 27 aa, Bacteroides dorei CL03T12C01
GRELGHKIGKAFYGACAMYGVYVLFCL

SEQ ID NO: 1503 - protein, 18 aa, Azoarcus sp. KH32C
TTLDAAAHQALEGWVSIP

SEQ ID NO: 1504 - protein, 22 aa, Streptococcus mitis bv. 2 str. F0392
SLATEWSTILTHATRRAYGIGY

SEQ ID NO: 1505 - protein, 29 aa, Caldicellulosiruptor saccharolyticus (strain ATCC 43494 / DSM 8903 / Tp8T 6331)
TLIKDLYEFAKELWDFGRGFADGWRDATR

SEQ ID NO: 1506 - protein, 19 aa, Calothrix sp. PCC 6303
SGVEGILDKVKARAQAYMK

SEQ ID NO: 1507 - protein, 27 aa, Xanthomonas hortorum pv. carotae str. M081
ATLTGGGGGIPNPIRVQPDGDVSVDFG

SEQ ID NO: 1508 - protein, 27 aa, Xanthomonas arboricola pv. pruni
ATLTGGGGGIPNPIRVQPDGDVSVDFG

SEQ ID NO: 1509 - protein, 27 aa, Xanthomonas arboricola pv. pruni str. MAFF 311562
ATLTGGGGGIPNPIRVQPDGDVSVDFG

SEQ ID NO: 1510 - protein, 27 aa, Xanthomonas arboricola pv. pruni MAFF 301420
ATLTGGGGGIPNPIRVQPDGDVSVDFG

SEQ ID NO: 1511 - protein, 13 aa, Vibrio tubiashii
SGPAWLNRYLNKR

SEQ ID NO: 1512 - protein, 42 aa, Streptococcus pneumoniae GA47502
GGLAVWEDGYSRWLYYREFAPYMRQGALNSYIDAWKYGFRAG

SEQ ID NO: 1513 - protein, 42 aa, Streptococcus pneumoniae GA41410; identical to SEQ ID NO: 1512

SEQ ID NO: 1514 - protein, 42 aa, Streptococcus pneumoniae PNI0446; identical to SEQ ID NO: 1512

SEQ ID NO: 1515 - protein, 42 aa, Streptococcus pneumoniae; identical to SEQ ID NO: 1512

SEQ ID NO: 1516 - protein, 23 aa, Leminorella grimontii ATCC 33999 = DSM 5078
AFGAAVGAVVGSDAATKFLKLFA

SEQ ID NO: 1517 - protein, 17 aa, Lactobacillus salivarius GJ-24
HIVDAVVSFGEGFLNAI

SEQ ID NO: 1518 - protein, 42 aa, Streptococcus pneumoniae (strain 70585); identical to SEQ ID NO: 1512

SEQ ID NO: 1519 - protein, 42 aa, Streptococcus pneumoniae 2070335; identical to SEQ ID NO: 1512

SEQ ID NO: 1520 - protein, 42 aa, Streptococcus pneumoniae (strain Hungary19A-6); identical to SEQ ID NO: 1512

SEQ ID NO: 1521 - protein, 42 aa, Streptococcus pneumoniae serotype 4 (strain ATCC BAA-334 / TIGR4); identical to SEQ ID NO: 1512

SEQ ID NO: 1522 - protein, 34 aa, Parabacteroides gordonii MS-1
EGGNQMAEDMGSMMGEAVGRAIKMFLFCAAIYAL

SEQ ID NO: 1523 - protein, 13 aa, Vibrio sp. VPAP30
SGPAWLNRYLNKR

SEQ ID NO: 1524 - protein, 13 aa, Vibrio tubiashii ATCC 19109
SGPAWLNRYLNKR

SEQ ID NO: 1525 - protein, 16 aa, Lactobacillus paracasei subsp. paracasei ATCC 25302
SGAKTGWEIANKYKIY

SEQ ID NO: 1526 - protein, 41 aa, Streptococcus vestibularis F0396
GICATAGAIIGGAFGAVPGALGGAVLGAQYCGGTWVIIRTH

SEQ ID NO: 1527 - protein, 18 aa, Sphingobacterium sp. PM2-P1-29
GAVAAGVGLVAAAKELFS

SEQ ID NO: 1528 - protein, 16 aa, Lactobacillus paracasei NRIC 0644
SGAKTGWEIANKYKIY

SEQ ID NO: 1529 - protein, 16 aa, Lactobacillus paracasei subsp. paracasei Lpp49
SGAKTGWEIANKYKIY

SEQ ID NO: 1530 - protein, 16 aa, Lactobacillus casei UW4
SGAKTGWEIANKYKIY

SEQ ID NO: 1531 - protein, 16 aa, Lactobacillus paracasei subsp. paracasei JCM 8130
SGAKTGWEIANKYKIY

SEQ ID NO: 1532 - protein, 16 aa, Lactobacillus paracasei subsp. paracasei Lpp7
SGAKTGWEIANKYKIY

SEQ ID NO: 1533 - protein, 16 aa, Lactobacillus casei W56
SGAKTGWEIANKYKIY

SEQ ID NO: 1534 - protein, 27 aa, Butyrivibrio fibrisolvens
GGGDGVFRTISHECHMNTWMFIFTCCS

SEQ ID NO: 1535 - protein, 28 aa, Streptococcus macacae NCTC 11558
AAIEGGFNPLKAIGDAAHDFAKGFHRGW

SEQ ID NO: 1536 - protein, 37 aa, Streptococcus mutans serotype c (strain ATCC 700610 / UA159)
GGAASGFTYCASNGVWHPYILAGCAGVGAVGSVVFPH

SEQ ID NO: 1537 - protein, 35 aa, Prochlorococcus sp. MIT 0701
ECVAGGVEFLSYRELVLKDIKKQQQRRVDILVSRM

SEQ ID NO: 1538 - protein, 41 aa, Streptococcus pneumoniae GA41410
GVLATAAGKIAYCIGYGALNRGCDISGNPYPWDGFISATVR

SEQ ID NO: 1539 - protein, 26 aa, Streptococcus oralis SK304
KVAGAVVTIGGALYGAGYAIGKALRP

SEQ ID NO: 1540 - protein, 22 aa, Streptococcus sp. M334
IAGSAFAGLSAGVAIGISRNKR

SEQ ID NO: 1541 - protein, 13 aa, Streptococcus mitis SK1080
LGAGLYQVGKNLK

SEQ ID NO: 1542 - protein, 22 aa, Streptococcus mitis
IAGSAFAGLSAGVAIGISRNKR

SEQ ID NO: 1543 - protein, 13 aa, Streptococcus mitis
LGAGLYQVGKNLK

SEQ ID NO: 1544 - protein, 13 aa, Streptococcus mitis
LGAGLYQVGKNLK

SEQ ID NO: 1545 - protein, 36 aa, Faecalibacterium prausnitzii A2-165
NYIARVFSAGSSIVNNINVIVTTFQTLSTFSLTAKN

SEQ ID NO: 1546 - protein, 22 aa, Streptococcus mitis 11/5
IAGSAFAGLSAGVAIGISRNKR

SEQ ID NO: 1547 - protein, 22 aa, Streptococcus sp. DORA_10
IAGSAFAGLSAGVAIGISRNKR

SEQ ID NO: 1548 - protein, 22 aa, Streptococcus mitis NCTC 12261
IAGSAFAGLSAGVAIGISRNKR

SEQ ID NO: 1549 - protein, 41 aa, Streptococcus vestibularis ATCC 49124
GICATAGAVIGGALGSVPGALGGAVLGAQYCGGTWVILRTH

SEQ ID NO: 1550 - protein, 23 aa, Nitritalea halalkaliphila LW7
QAINDFVDGFNETPCSCEEIKEN

SEQ ID NO: 1551 - protein, 18 aa, Halobacteroides halobius (strain ATCC 35273 / DSM 5150 / MD-1)
RFGKGVVEGYSEAEAEDK

SEQ ID NO: 1552 - protein, 20 aa, Synechococcus sp. (strain ATCC 27167 / PCC 6312)
GGFRSYGRQLDGQRRNNTQS

SEQ ID NO: 1553 - protein, 27 aa, Thermoanaerobacter kivui (Acetogenium kivui)
GIIDAVYDFGKGFVDGFKAAYARDRDK

SEQ ID NO: 1554 - protein, 20 aa, Streptococcus mitis SK321
MGQGALNSYRDAWKYGFRAG

SEQ ID NO: 1555 - protein, 20 aa, Streptococcus mitis
MGQGALNSYRDAWKYGLRAG

SEQ ID NO: 1556 - protein, 24 aa, Belliella baltica (strain DSM 15883 / CIP 108006 / LMG 21964 / BA134)
AEAVVNGGKAIANAGIWIWNQLVD

SEQ ID NO: 1557 - protein, 37 aa, Gallibacterium anatis
SGLTAGYSLVRRTPALPAVATGLAISVITDAILSMTI

SEQ ID NO: 1558 - protein, 37 aa, Gallibacterium anatis 12656/12; identical to SEQ ID NO: 1557

SEQ ID NO: 1559 - protein, 42 aa, Prevotella multisaccharivorax DSM 17128
LGRGLGCGRGCGGCTPASNPSGPSSPSAPSAPSTSSASSVLV

SEQ ID NO: 1560 - protein, 14 aa, Paenibacillus wynnii
DFLKGIKAGWDSYN

SEQ ID NO: 1561 - protein, 42 aa, Flavobacterium cauense R2A-7
TGYEFFAGYISDVFYDEDGNGQVNSDAEAGSYISVIADPPKP

SEQ ID NO: 1562 - protein, 29 aa, Streptococcus macedonicus
ELLGGAGHGVNTISAECRWNSLQAIFSCC

SEQ ID NO: 1563 - protein, 29 aa, Streptococcus macedonicus (strain ACA-DC 198)
ELLGGAGHGVNTISAECRWNSLQAIFSCC

SEQ ID NO: 1564 - protein, 29 aa, Streptococcus agalactiae (strain ATCC 13813 / DSM 2134 / JCM 5671 / NCIMB 701348 / NCTC 8181)
ELLGGAGHGVNTISAECRWNSLQAIFSCC

SEQ ID NO: 1565 - protein, 31 aa, Synechococcus sp. RS9916
GAGRAIYEGVRTVSPAVRIGEWIAGGRYPWQ

SEQ ID NO: 1566 - protein, 14 aa, Streptococcus downei F0415
VNSWASGVASFAAY

SEQ ID NO: 1567 - protein, 13 aa, Streptococcus mitis
LGAGLYQVGKNLK

SEQ ID NO: 1568 - protein, 42 aa, Corynebacterium terpenotabidum Y-11
GGRPGESVGESVPDCAVRDLTAGPPEMVAHQHRTEPGCAGGQ

SEQ ID NO: 1569 - protein, 41 aa, Streptococcus macedonicus
GMAEGAIGGALAGGPIGAGIGIGLGQIGGSIYCIGNILGGK

SEQ ID NO: 1570 - protein, 17 aa, Streptococcus australis ATCC 700641
IAGGVTAVGTAIWGAFK

SEQ ID NO: 1571 - protein, 26 aa, Chryseobacterium oranimense G311
AAANALVAAADTIASHPVGGPRGGYN

SEQ ID NO: 1572 - protein, 37 aa, Streptococcus mutans 2ST1; identical to SEQ ID NO: 1536

SEQ ID NO: 1573 - protein, 19 aa, Sphingobacterium sp. (strain 21)
GGAGGLLELGAAAYIMAYC

SEQ ID NO: 1574 - protein, 42 aa, Streptococcus pneumoniae PCS8203
GGLAVWEDGYSRWLYYREFAPYMRQGALNSYIDAWKYGFRTG

SEQ ID NO: 1575 - protein, 42 aa, Streptococcus pneumoniae PCS8106; identical to SEQ ID NO: 1574

SEQ ID NO: 1576 - protein, 21 aa, Streptococcus mitis SK569
GIFEDAVKWCDKLFSTGRHFA

SEQ ID NO: 1577 - protein, 21 aa, Streptococcus mitis
GIFEDAVKWCDKLFSTGRHFA

SEQ ID NO: 1578 - protein, 42 aa, Streptococcus pneumoniae; identical to SEQ ID NO: 1512

SEQ ID NO: 1579 - protein, 42 aa, Streptococcus pneumoniae; identical to SEQ ID NO: 1574

SEQ ID NO: 1580 - protein, 20 aa, Streptococcus oralis SK255
MGQGALNSYRDAWKYGFRAG

SEQ ID NO: 1581 - protein, 20 aa, Streptococcus oralis SK304
IGQGALNSYRDAWKYGFRAG

SEQ ID NO: 1582 - protein, 23 aa, Lactococcus raffinolactis 4877
ISGGGAIGSGMVSGMLLAKPLNH

SEQ ID NO: 1583 - protein, 42 aa, Streptococcus pneumoniae (strain JJA); identical to SEQ ID NO: 1574

SEQ ID NO: 1584 - protein, 42 aa, Streptococcus pneumoniae (strain ATCC BAA-255 / R6); identical to SEQ ID NO: 1574

SEQ ID NO: 1585 - protein, 42 aa, Streptococcus pneumoniae serotype 2 (strain D39 / NCTC 7466); identical to SEQ ID NO: 1574

SEQ ID NO: 1586 - protein, 42 aa, Streptococcus pneumoniae SP6-BS73; identical to SEQ ID NO: 1574

SEQ ID NO: 1587 - protein, 27 aa, Thalassomonas viridans
GGAEGINSFFSTAWNNDPVVKWVRSIE

SEQ ID NO: 1588 - protein, 16 aa, Streptobacillus moniliformis (strain ATCC 14647 / DSM 12112 / NCTC 10651 / 9901)
EMIRQGIDDFKEGWNE

SEQ ID NO: 1589 - protein, 14 aa, Streptococcus sp. AS20
YMGWGNSGGNGAWG

SEQ ID NO: 1590 - protein, 23 aa, Lactobacillus casei
LATDAFNHADQLIDGFKQGWERP

SEQ ID NO: 1591 - protein, 24 aa, Lactobacillus casei subsp. casei ATCC 393
LATDAFNHADQLIDGFKQGWERPW

SEQ ID NO: 1592 - protein, 38 aa, Odoribacter sp. CAG:788
VEEYCATLTNMMDGEYAKTEWTAEQWTNAWNAYSKHCK

SEQ ID NO: 1593 - protein, 40 aa, Streptococcus infantarius subsp. infantarius; identical to SEQ ID NO: 987

SEQ ID NO: 1594 - protein, 38 aa, Bacteroides salyersiae CL02T12C01
QVYGGGFDEGKSVGYQIGKTISGAIALYGFYVLVAALV

SEQ ID NO: 1595 - protein, 12 aa, Lactococcus raffinolactis 4877
AGYTIGKDIAKR

SEQ ID NO: 1596 - protein, 42 aa, Clostridium botulinum CFSAN002367
GKGAVTGALTGAGFGGAPGAILGAVYGAPFGALDYVISDRLK

SEQ ID NO: 1597 - protein, 42 aa, Clostridium botulinum CFSAN001627; identical to SEQ ID NO: 1596

SEQ ID NO: 1598 - protein, 32 aa, Streptococcus pneumoniae GA44500
SGGLAVWEDGYSRWLYYREFAPYMRQGHLILI

SEQ ID NO: 1599 - protein, 24 aa, Streptococcus gordonii (strain Challis / ATCC 35105 / BCRC 15272 / CH1 / DL1 / V288)
IGAGIVAGLGGGFFGGYALARIFG

SEQ ID NO: 1600 - protein, 24 aa, Streptococcus gordonii
IGAGIVAGLGGGFFGGYALARIFG

SEQ ID NO: 1601 - protein, 42 aa, Catenovulum agarivorans DS-2
SALGTGGALMAAANGARWGAVGGVAGMAVGAAAGFAYYYYFS

SEQ ID NO: 1602 - protein, 38 aa, Bacteroides fragilis HMW 610
YNKMEKILEKLSPEELDSIKGGTWVLIDTGWVWIEGTI

SEQ ID NO: 1603 - protein, 38 aa, Bacteroides fragilis HMW 616
YNKMEKILEKLSPEELDSIKGGTWVLTDTGWVWIEGTI

SEQ ID NO: 1604 - protein, 24 aa, Calothrix sp. PCC 7507
SSADSALQSVNRITNALHLIYLNI

SEQ ID NO: 1605 - protein, 12 aa, Prevotella sp. F0091
WEEWCGLYDKYC

SEQ ID NO: 1606 - protein, 14 aa, Streptococcus mitis SK616
KWCDKLFSTGRHFA

SEQ ID NO: 1607 - protein, 21 aa, Streptococcus mitis
GIFEDAVKWCDKLFSTGRHFA

SEQ ID NO: 1608 - protein, 14 aa, Paenibacillus sp. VT-400
KGLTSGIADGWNKR

SEQ ID NO: 1609 - protein, 41 aa, Streptococcus pneumoniae
GVLATAAGKIAYCIGYGALNRGCDINGNPYPWDGFISATVR

SEQ ID NO: 1610 - protein, 32 aa, Prevotella bryantii B14
KALQALADAYAKDGATNRQWDEWCDAYEAHGC

SEQ ID NO: 1611 - protein, 37 aa, Legionella oakridgensis ATCC 33761 = DSM 21215
LSKVSGGASQMTHSETVKGTGGSGQGVDVVYDQSVDW

SEQ ID NO: 1612 - protein, 40 aa, Lactobacillus paracasei subsp. paracasei Lpp225
GGGGGGGGSFSLSDLPGPQTTPYYGDAYQYRFAGRHWGTN

SEQ ID NO: 1613 - protein, 26 aa, Streptococcus sp. oral taxon 071 str. 73H25AP
KVAGAVVTIGGALYGAGYAIGKALRP

SEQ ID NO: 1614 - protein, 26 aa, Streptococcus sp. F0441
KVAGAVVTIGGALYGAGYAIGKALRP

SEQ ID NO: 1615 - protein, 37 aa, Ewingella americana ATCC 33852
GLIGDLLGTVGQIVTPLPIVGPILGGILGNIGGKFPL

SEQ ID NO: 1616 - protein, 34 aa, Streptococcus salivarius SK126
GILSSVAGLVKDTWGTLYSTGRDFGRSVVNAAMP

SEQ ID NO: 1617 - protein, 19 aa, Pedobacter kyungheensis
SLGNNIGGSLEGLFKSLTS

SEQ ID NO: 1618 - protein, 12 aa, Streptococcus suis R61
IIDFGQGFLDAF

SEQ ID NO: 1619 - protein, 30 aa, Streptomyces sp. NRRL S-104
VQAATGIVSHVPGLVTGVTGVSVNAGRAGL

SEQ ID NO: 1620 - protein, 27 aa, Butyrivibrio fibrisolvens
GGGDGVFRTISHECAMNTWMFIFTCCS

SEQ ID NO: 1621 - protein, 14 aa, Streptococcus mitis SK1080
KWCNKLFGTGRHVA

SEQ ID NO: 1622 - protein, 14 aa, Streptococcus mitis
KWCNKLFGTGRHVA

SEQ ID NO: 1623 - protein, 14 aa, Streptococcus mitis (strain B6)
KWCNKLFGTGRHVA

SEQ ID NO: 1624 - protein, 41 aa, Bacteroides cellulosilyticus CL02T12C19
DDMEKVAGGLLDLKCVNNNVPLCGCSQTSTEKLQQATKDQG

SEQ ID NO: 1625 - protein, 41 aa, Streptococcus gordonii
EGGTDWVKCYAGTIGSAILGFGAMGPIGYWAGAGVGYASFC

SEQ ID NO: 1626 - protein, 28 aa, Streptococcus vestibularis ATCC 49124
TIGSALVGSAGGPVGYRGGALVGYATFC

SEQ ID NO: 1627 - protein, 27 aa, Streptococcus salivarius SK126
KVIGGVAGVIAASGAAGIAAGYYANRP

SEQ ID NO: 1628 - protein, 23 aa, Streptococcus sp. oral taxon 056 str. F0418
GVGIVAGLGGGFFGGYTLARLFG

SEQ ID NO: 1629 - protein, 27 aa, Streptococcus salivarius (strain 57.I)
KVIGGVAGVIAASGAAGIAAGYYANRP

SEQ ID NO: 1630 - protein, 27 aa, Streptococcus salivarius (strain CCHSS3)
KVIGGVAGVIAASGAAGIAAGYYANRP

SEQ ID NO: 1631 - protein, 42 aa, Clostridium sp. ASF502
CDTAYSKMTDYASQAEDPEIKKLFQDAADSAMQNRQELMKFL

SEQ ID NO: 1632 - protein, 35 aa, Alteromonas sp. (strain SN2)
GWVGAAIGAISGGLGYAGSKVGDKMSERTTSTTDE

SEQ ID NO: 1633 - protein, 19 aa, Pedobacter kyungheensis
SIGNNIGGSLKGLFDSLSR

SEQ ID NO: 1634 - protein, 20 aa, Streptococcus tigurinus AZ_3a
MGQGALNSYRDAWKYGFRAG

SEQ ID NO: 1635 - protein, 37 aa, Cellulosilyticum lentocellum (strain ATCC 49066 / DSM 5427 / NCIMB 11756 / RHM5) (Clostridium lentocellum)
LEEVNGGGAGAVIAVVVVICVIAFAVGVYNGYQDNKK

SEQ ID NO: 1636 - protein, 40 aa, Scytonema millei VB511283
ALAASMADKIAQWGAAADRMTKGDNAASGIDISRAMAGGR

SEQ ID NO: 1637 - protein, 26 aa, Dysgonomonas gadei ATCC BAA-286
DYLKDLYESAGAAVAAGAAAGAAAIR

SEQ ID NO: 1638 - protein, 12 aa, Leminorella grimontii ATCC 33999 = DSM 5078
TTLSQFFSKLFG

SEQ ID NO: 1639 - protein, 16 aa, Streptococcus mitis
VSAGAGIAAGYYANRP

SEQ ID NO: 1640 - protein, 34 aa, Streptococcus sp. DORA_10
AAIGSLVAPGAGTWAGGILGAQYCTAIWGIARSL

SEQ ID NO: 1641 - protein, 34 aa, Streptococcus mitis SK1073; identical to SEQ ID NO: 1640

SEQ ID NO: 1642 - protein, 34 aa, Streptococcus mitis SK616; identical to SEQ ID NO: 1640

SEQ ID NO: 1643 - protein, 27 aa, Streptococcus mitis SK1073
KIGAAVAGGAAALFAGGAALGYYANRP

SEQ ID NO: 1644 - protein, 27 aa, Streptococcus mitis SK579
KLIGGVAALATASAGAGIAAGYYANRP

SEQ ID NO: 1645 - protein, 27 aa, Streptococcus mitis SK575
KIGAAVAGGAAALFAGGAALGYYANRP

SEQ ID NO: 1646 - protein, 16 aa, Streptococcus sp. M334
VSAGAGIAAGYYANRP

SEQ ID NO: 1647 - protein, 23 aa, Streptococcus oralis ATCC 35037
AAKIAGGITAAGIAGYNYVTGRW

SEQ ID NO: 1648 - protein, 27 aa, Streptococcus mitis 27/7
KLIGGVAALATASAGAGIAAGYYANRP

SEQ ID NO: 1649 - protein, 16 aa, Streptococcus mitis
VSAGAGIAAGYYANRP

SEQ ID NO: 1650 - protein, 27 aa, Streptococcus mitis
KIGAAVAGGAAALFAGGAALGYYANRP

SEQ ID NO: 1651 - protein, 16 aa, Streptococcus mitis SK321
VSAGAGIAAGYYANRP

SEQ ID NO: 1652 - protein, 42 aa, Streptococcus vestibularis ATCC 49124
FLSSVGGAAEGVYYCAGVGALTPYTVVGCAGIGAVVGAFFPH

SEQ ID NO: 1653 - protein, 15 aa, Streptococcus salivarius SK126
GCGVVGAGLGYAFPH

SEQ ID NO: 1654 - protein, 22 aa, [Eubacterium] rectale DSM 17629
AGVSAGGGCASAGLSLIGSACH

SEQ ID NO: 1655 - protein, 19 aa, Streptococcus mitis SK564
VGHALSAGVAVGFAALATN

SEQ ID NO: 1656 - protein, 19 aa, Streptococcus mitis 21/39
VGHALSAGVAVGFAALATN

SEQ ID NO: 1657 - protein, 38 aa, Methylobacterium nodulans (strain ORS2060 / LMG 21967)
SVLTGVVNAVANGISAGIKVINMDQKETYTGKYGSVTF

SEQ ID NO: 1658 - protein, 14 aa, Streptococcus infantarius (strain CJ18)
AMAVGGAAAGSFCR

SEQ ID NO: 1659 - protein, 14 aa, Streptococcus infantarius subsp. infantarius ATCC BAA-102
AMAVGGAAAGSFCR

SEQ ID NO: 1660 - protein, 14 aa, Streptococcus pseudopneumoniae 22725
KWCDKLFSTGRHFA

SEQ ID NO: 1661 - protein, 21 aa, Streptococcus pseudopneumoniae (strain IS7493)
GIFEDAVKWCDKLFSTGRHFA

SEQ ID NO: 1662 - protein, 14 aa, Streptococcus infantarius subsp. infantarius
AMAVGGAAAGSFCR

SEQ ID NO: 1663 - protein, 34 aa, Halobacteroides halobius (strain ATCC 35273 / DSM 5150 / MD-1)
AGAAAFYGGASAASAIGTTIGGIATTVGTATTVF

SEQ ID NO: 1664 - protein, 21 aa, Streptococcus mitis SK597
GIFEDAVKWCDKLFSTGRHFA

SEQ ID NO: 1665 - protein, 23 aa, Hafnia alvei ATCC 13337
SDMAGLIGGAITITNTAQETLKS

SEQ ID NO: 1666 - protein, 26 aa, Bacillus cereus VDM022
IIGSMGGPWGALGGGVTGAALCYLND

SEQ ID NO: 1667 - protein, 32 aa, Xylella fastidiosa PLS229
LNSVGGGYEDAYKNYFDDKNPLKPMFEDYVKS

SEQ ID NO: 1668 - protein, 30 aa, Streptococcus pneumoniae GA44500
KRACQGICAALAMSPGTFIALAGAAVLTKN

SEQ ID NO: 1669 - protein, 21 aa, Paenibacillus sp. FSL R7-0273
AAMAVGGSIVSGYLVGTGLRP

SEQ ID NO: 1670 - protein, 19 aa, Streptococcus macacae NCTC 11558
GGPAGMAAGCAVGVVESFF

SEQ ID NO: 1671 - protein, 23 aa, Prochlorococcus sp. MIT 0701
YKKVANYLREIDPEDFILGGPQL

SEQ ID NO: 1672 - protein, 34 aa, Streptococcus thermophilus JIM 8232
SHGGSDATSGASDASGHAGDASPAADATSGASSY

SEQ ID NO: 1673 - protein, 16 aa, Streptococcus sp. SR4
VAVGATIGGGVALLGC

SEQ ID NO: 1674 - protein, 31 aa, Parabacteroides gordonii MS-1
LEEINGGIAGLIIGCIGIAAICYYFGDHSAR

SEQ ID NO: 1675 - protein, 16 aa, Streptococcus salivarius
VAVGATIGGGVALLGC

SEQ ID NO: 1676 - protein, 12 aa, Haliscomenobacter hydrossis (strain ATCC 27775 / DSM 1100 / LMG 10767 / O)
EGLQAGWEAAGK

SEQ ID NO: 1677 - protein, 25 aa, Streptococcus macacae NCTC 11558
SAYQAGYATGRAIAIAAVAATFAAL

SEQ ID NO: 1678 - protein, 31 aa, Klebsiella pneumoniae IS53
EYISGGFNLFGAAAASPALSPTLASASPLLF

SEQ ID NO: 1679 - protein, 27 aa, Streptococcus mitis
KVGAAVAGGATALFAGGAALGYYANRP

SEQ ID NO: 1680 - protein, 39 aa, Stenotrophomonas maltophilia AU12-09
EELMNVGGGALEAAPASTGSAGGKVTSGGDWEVNVGIDW

SEQ ID NO: 1681 - protein, 16 aa, Streptococcus salivarius (strain JIM8777)
VAVGATIGGGVALLGC

SEQ ID NO: 1682 - protein, 34 aa, Prochlorococcus marinus (strain MIT 9303)
EELEGVAGGAIGQQSGSMGDLWFACYIGEACKGE

SEQ ID NO: 1683 - protein, 22 aa, Streptococcus sp. oral taxon 056 str. F0418
SGGNNFGDLLRQWWWSVFRGDD

SEQ ID NO: 1684 - protein, 27 aa, Streptococcus oralis SK255
KLIGGVAALATTSAGVGVAAGYYANRP

SEQ ID NO: 1685 - protein, 27 aa, Streptococcus sp. M143
KVGAAVVGGATALFAGGAALGYYANRP

SEQ ID NO: 1686 - protein, 27 aa, Streptococcus mitis bv. 2 str. SK95
KVGAAVVGGATALFAGGATLGYYANRP

SEQ ID NO: 1687 - protein, 23 aa, Streptococcus mitis ATCC 6249
AAKIAGGITAVGIAGYNYVTGRW

SEQ ID NO: 1688 - protein, 27 aa, Streptococcus pseudopneumoniae 22725
KIGAAVAGGAAALFAGGAALGYYANRP

SEQ ID NO: 1689 - protein, 23 aa, Streptococcus mitis
AAVAGGAALFAGGAALGYYANRP

SEQ ID NO: 1690 - protein, 27 aa, Streptococcus pseudopneumoniae 5247
KIGAAVAGGAAALFAGGAALGYYANRP

SEQ ID NO: 1691 - protein, 27 aa, Streptococcus mitis (strain B6)
KLIGGVAALATASAGAGIAAGYYANRP

SEQ ID NO: 1692 - protein, 27 aa, Streptococcus pseudopneumoniae (strain IS7493)
KIGAAVAGGAAALFAGGAALGYYANRP

SEQ ID NO: 1693 - protein, 27 aa, Streptococcus mitis
KVGGAVVGGATALFAGGAALGYYANRP

SEQ ID NO: 1694 - protein, 19 aa, Streptococcus sp. DORA_10
GGGIFEDIYHWLHLLPEPR

SEQ ID NO: 1695 - protein, 19 aa, Streptococcus mitis
GGGIFEDIYHWLHLLPEPR

SEQ ID NO: 1696 - protein, 32 aa, Bacteroides vulgatus PC510
SQGESAAGDGYAIKCCNNKGKQEQQKTVDPTT

SEQ ID NO: 1697 - protein, 19 aa, Streptococcus mitis 27/7
GGGIFEDIYHWLHLLPEPR

SEQ ID NO: 1698 - protein, 19 aa, Streptococcus mitis 11/5
GGGIFEDIYHWLHLLPEPR

SEQ ID NO: 1699 - protein, 20 aa, Clostridium pasteurianum DSM 525 = ATCC 6013
GGGIYDKINKFLSNSKHYFI

SEQ ID NO: 1700 - protein, 35 aa, Burkholderia sp. (strain CCGE1002)
GQHVGSILTTADGDPVAVYVDGVLQNSVTDGFYHG

SEQ ID NO: 1701 - protein, 32 aa, Bacteroides vulgatus str. 3775 SL(B) 10 (iv); identical to SEQ ID NO: 1696

SEQ ID NO: 1702 - protein, 32 aa, Bacteroides vulgatus str. 3975 RP4; identical to SEQ ID NO: 1696

SEQ ID NO: 1703 - protein, 32 aa, Bacteroides vulgatus dnLKV7; identical to SEQ ID NO: 1696

SEQ ID NO: 1704 - protein, 22 aa, Streptococcus mitis
AGEVCTLAGAMIGSLVAPRAGT

SEQ ID NO: 1705 - protein, 22 aa, Streptococcus mitis SK569
AGEVCTLAGAMIGSLVAPRSGT

SEQ ID NO: 1706 - protein, 33 aa, Bacteroides salanitronis (strain DSM 18170 / JCM 13567 / BL78)
NGGGIWTEVFKALIASYEMASDFKEGWDSVPDL

SEQ ID NO: 1707 - protein, 42 aa, Rothia dentocariosa
GGGSHGGGYYSSVGGGSYGGGYCGGGCGGYGYGFGFWGGSFS

SEQ ID NO: 1708 - protein, 42 aa, Rothia aeria F0184; identical to SEQ ID NO: 1707

SEQ ID NO: 1709 - protein, 42 aa, Rothia aeria F0474; identical to SEQ ID NO: 1707

SEQ ID NO: 1710 - protein, 19 aa, Streptococcus mitis SK616
GIYQVGEAAGKTFYYITHP

SEQ ID NO: 1711 - protein, 19 aa, Streptococcus mitis SK569
GIYQVGEAAGKTFYYITHP

SEQ ID NO: 1712 - protein, 19 aa, Streptococcus mitis 21/39
GIYQAGEAAGKTFYYITHP

SEQ ID NO: 1713 - protein, 19 aa, Streptococcus mitis 17/34
GIYQVGEAAGKTFYYITHP

SEQ ID NO: 1714 - protein, 19 aa, Streptococcus mitis SK1073
GGGIFEDIYHWLHLLPDPR

SEQ ID NO: 1715 - protein, 19 aa, Streptococcus oralis SK610
GIYQVGEAAGKTFYYITHP

SEQ ID NO: 1716 - protein, 19 aa, Streptococcus mitis SK564
GIYQAGEAAGKTFYYITHP

SEQ ID NO: 1717 - protein, 37 aa, Scytonema tolypothrichoides VB-61278
VGVADAIVRAVNIVYETARPTLQSLPLLGPILADDEQ

SEQ ID NO: 1718 - protein, 40 aa, Streptococcus thermophilus TH1435
GASEGFSAAAGGTAFFIGPYAIGTGAVGAAIGGGVALLGC

SEQ ID NO: 1719 - protein, 37 aa, Pseudomonas syringae pv. syringae HS191
VAATALAPATAVGAGVILAGVAAVSAFDAFQSYQMAQ

SEQ ID NO: 1720 - protein, 40 aa, Streptococcus thermophilus M17PTZA496; identical to SEQ ID NO: 1718

SEQ ID NO: 1721 - protein, 40 aa, Streptococcus thermophilus TH1477; identical to SEQ ID NO: 1718

SEQ ID NO: 1722 - protein, 37 aa, Pseudomonas syringae Cit 7; identical to SEQ ID NO: 1719

SEQ ID NO: 1723 - protein, 37 aa, Pseudomonas savastanoi pv. phaseolicola (strain 1448A / Race 6) (Pseudomonas syringae pv. phaseolicola (strain 1448A / Race 6))
AAATALAPVTAVGAGVILVGVAGASAIDAFQTYQMAQ

SEQ ID NO: 1724 - protein, 40 aa, Streptococcus sp. HSISS3; identical to SEQ ID NO: 1718

SEQ ID NO: 1725 - protein, 40 aa, Streptococcus thermophilus JIM 8232; identical to SEQ ID NO: 1718

SEQ ID NO: 1726 - protein, 31 aa, Enterobacter aerogenes (strain ATCC 13048 / DSM 30053 / JCM 1235 / KCTC 2190 / NBRC 13534 / NCIMB 10102 / NCTC 10006) (Aerobacter aerogenes)
LGAGFAVMAAGIVGTSLAGAAMIVSICTPVL

SEQ ID NO: 1727 - protein, 31 aa, Enterobacter aerogenes (Aerobacter aerogenes)
LGAGFAVMAAGIVGTSLAGAAMIVSICTPIL

SEQ ID NO: 1728 - protein, 29 aa, Rhodonellum psychrophilum GCM71 = DSM 17998
EAVYEFGSGFAENIGPAFERAFNNIKYQN

SEQ ID NO: 1729 - protein, 30 aa, Tolypothrix bouteillei VB521301
VLKSMNAVASAFQFIALDLNDVSTTRAVEN

SEQ ID NO: 1730 - protein, 30 aa, Streptomyces sp. NRRL F-4428
VQAATGIVSHVPGLVTGITGVSVNAGRAGL

SEQ ID NO: 1731 - protein, 42 aa, Synechococcus sp. PCC 7335
EQLEEVAGGGSHKQIEEHFEEDQNAAVPGNTTIDRGPEPQVI

SEQ ID NO: 1732 - protein, 31 aa, Streptomyces natalensis ATCC 27448
VGDVAGTAQALAAETPASQLAQLVTVHTFGI

SEQ ID NO: 1733 - protein, 19 aa, Streptococcus infantis SK1302
GIYQVGEAAGKTFYYITHP

SEQ ID NO: 1734 - protein, 21 aa, Vibrio maritimus
AGGNVVTAFATEDSIALNIDK

SEQ ID NO: 1735 - protein, 34 aa, Nostoc punctiforme (strain ATCC 29133 / PCC 73102)
AVCAVGGAVLGGPAGFLGGAFVGAILATIVASQE

SEQ ID NO: 1736 - protein, 13 aa, Bacteroides oleiciplenus YIT 12058
WDGWNKAFDNACL

SEQ ID NO: 1737 - protein, 21 aa, Clostridium perfringens (strain SM101 / Type A)
AGLAAAGAVLAGGVAVYEAWH

SEQ ID NO: 1738 - protein, 21 aa, Clostridium perfringens C str. JGS1495
AGLAAAGAVLAGGVAVYEAWH

SEQ ID NO: 1739 - protein, 28 aa, Streptococcus mitis
AGEVCTLAGAMIGSLVAPRAGTWAGGVL

SEQ ID NO: 1740 - protein, 42 aa, Streptococcus vestibularis F0396
FLSSVGGAAEGVYYCAGVGALTPYTVVGCAGIGAVVGSFFPQ

SEQ ID NO: 1741 - protein, 23 aa, Streptococcus sp. CM6
AAKIAGGITAAGIAGYNYVTGRW

SEQ ID NO: 1742 - protein, 23 aa, Streptococcus sp. C300
AAKIAGGITAAGIAGYNYVTSRW

SEQ ID NO: 1743 - protein, 23 aa, Streptococcus oralis SK10
AAKIAGGITAAGIAGYNYVTGRW

SEQ ID NO: 1744 - protein, 23 aa, Streptococcus sp. BS21
AAKIAGGITAAGIAGYNYVTSRW

SEQ ID NO: 1745 - protein, 23 aa, Streptococcus sp. BS35b
AAKIAGGITAAGIAGYNYVTSRW

SEQ ID NO: 1746 - protein, 23 aa, Streptococcus oralis ATCC 49296
AAKIAGGITAAGVAGYNYVTGRW

SEQ ID NO: 1747 - protein, 23 aa, Streptococcus sp. BS29a
AAKIAGGITAAGIAGYNYVTSRW

SEQ ID NO: 1748 - protein, 23 aa, Streptococcus oralis SK313
AAKIAGGITAAGIAGYNYVTGRW

SEQ ID NO: 1749 - protein, 23 aa, Streptococcus oralis SK1074
AAKIAGGITAAGIAGYNYVTSRW

SEQ ID NO: 1750 - protein, 28 aa, Streptococcus mitis NCTC 12261
AGEVCTLAGAMIGSLVAPRAGTWAGGVL

SEQ ID NO: 1751 - protein, 23 aa, Streptococcus sp. GMD4S
AAKIAGGITAAGIAGYNYVTSRW

SEQ ID NO: 1752 - protein, 23 aa, Streptococcus sp. GMD6S
AAKIAGGITAAGIAGYNYVTSRW

SEQ ID NO: 1753 - protein, 23 aa, Scytonema millei VB511283
AYADELTRLAAALDVDIKTLLLQ

SEQ ID NO: 1754 - protein, 19 aa, Acidocella sp. MX-AZ02
EAADALLAVLDEIKRRAAA

SEQ ID NO: 1755 - protein, 18 aa, Halobacteroides halobius (strain ATCC 35273 / DSM 5150 / MD-1)
AMVKDGWKLIETASENAY

SEQ ID NO: 1756 - protein, 19 aa, Pedobacter sp. BMA
SLGNNIGGSLAGIFDSLKS

SEQ ID NO: 1757 - protein, 18 aa, Thermoanaerobacter kivui (Acetogenium kivui)
DFGNGVVDGFKDGLNAWK

SEQ ID NO: 1758 - protein, 26 aa, Flavihumibacter sp. ZG627
TIVKSIVTLAETAMDYQASLSTSDKK

SEQ ID NO: 1759 - protein, 19 aa, Pedobacter sp. BMA
SLGNNIGGSLEGLFQSLTS

SEQ ID NO: 1760 - protein, 22 aa, Galbibacter marinus
AVGAAIGYGASAAIEGIEGWFE

SEQ ID NO: 1761 - protein, 19 aa, Streptococcus tigurinus 2426
GIYQVGEAAGKTFYYITHP

SEQ ID NO: 1762 - protein, 19 aa, Streptococcus sp. SR1
GIYQVGEAAGKTFYYITHP

SEQ ID NO: 1763 - protein, 19 aa, Streptococcus mitis
GIYQAGEAAGKTFYYITHP

SEQ ID NO: 1764 - protein, 19 aa, Streptococcus mitis SK597
GIYQAGEAAGKTFYYITHP

SEQ ID NO: 1765 - protein, 31 aa, Streptomyces pristinaespiralis ATCC 25486
VGDVVGTVQSVAAVVPVAAATGLVSVQTTGI

SEQ ID NO: 1766 - protein, 13 aa, Calothrix sp. PCC 6303
NIDSFGQKFIQSF

SEQ ID NO: 1767 - protein, 24 aa, Streptococcus suis (strain BM407)
ALLGSVGGPWGSAAGGAVGAGFFC

SEQ ID NO: 1768 - protein, 28 aa, Streptococcus sp. ACS2
TIGSALVGSAGGPVGYWGGALVGYATFC

SEQ ID NO: 1769 - protein, 40 aa, Streptococcus pyogenes
NIGSAIGGCLGGMLIAAAGGPITGGAAAFVCVASGIAAYQ

SEQ ID NO: 1770 - protein, 28 aa, Streptococcus sp. C150
TIGSALVGSAGGPVGYWGGALVGYATFC

SEQ ID NO: 1771 - protein, 40 aa, Streptococcus pyogenes GA06023; identical to SEQ ID NO: 1769

SEQ ID NO: 1772 - protein, 28 aa, Streptococcus salivarius
TIGSALVGSAGGPVGYWGGALVGYATFC

SEQ ID NO: 1773 - protein, 16 aa, Streptococcus salivarius PS4
GGAGGAVAYGATCWWS

SEQ ID NO: 1774 - protein, 40 aa, Streptococcus pyogenes serotype M49 (strain NZ131); identical to SEQ ID NO: 1769

SEQ ID NO: 1775 - protein, 28 aa, Streptococcus salivarius K12
TIGSALVGSAGGPVGYWGGALVGYATFC

SEQ ID NO: 1776 - protein, 40 aa, Streptococcus dysgalactiae subsp. equisimilis RE378; identical to SEQ ID NO: 1769

SEQ ID NO: 1777 - protein, 28 aa, Streptococcus salivarius CAG:79
TIGSALVGSAGGPVGYWGGALVGYATFC

SEQ ID NO: 1778 - protein, 40 aa, Streptococcus pyogenes serotype M1; identical to SEQ ID NO: 1769

SEQ ID NO: 1779 - protein, 40 aa, Streptococcus pyogenes serotype M6 (strain ATCC BAA-946 / MGAS10394); identical to SEQ ID NO: 1769

SEQ ID NO: 1780 - protein, 28 aa, Streptococcus sp. HSISS3
TIGSALVGSAGGPVGYWGGALVGYATFC

SEQ ID NO: 1781 - protein, 40 aa, Streptococcus pyogenes serotype M28 (strain MGAS6180); identical to SEQ ID NO: 1769

SEQ ID NO: 1782 - protein, 28 aa, Streptococcus salivarius M18
TIGSALVGSAGGPVGYWGGALVGYATFC

SEQ ID NO: 1783 - protein, 33 aa, Clostridium perfringens F262
AAAAIYAGCAAGGFVAGVGVTVGTVKFLNWIGA

SEQ ID NO: 1784 - protein, 37 aa, Synechococcus sp. RS9916
GFLKDLVNGVADFTPAGPVNRTMQRAGGPTIGDYVVG

SEQ ID NO: 1785 - protein, 13 aa, Bacteroides intestinalis CAG:315
WDGWNEAFDNACL

SEQ ID NO: 1786 - protein, 23 aa, Streptococcus sp. oral taxon 071 str. 73H25AP
KAIAGGAALIGSGLAAGYFLGGD

SEQ ID NO: 1787 - protein, 35 aa, Haliangium ochraceum (strain DSM 14365 / JCM 11303 / SMP-2)
LESVAGGITDLTTEASCMCCAAGATNQTPGFEEQR

SEQ ID NO: 1788 - protein, 13 aa, Calothrix sp. PCC 6303
NIDSFGEKFVQSF

SEQ ID NO: 1789 - protein, 39 aa, Halobacteroides halobius (strain ATCC 35273 / DSM 5150 / MD-1)
DFVESCGKVVGRGLEAVVDEANESAREDFESGTWSSRSM

SEQ ID NO: 1790 - protein, 21 aa, Lactococcus lactis subsp. lactis bv. diacetylactis str. TIFN2
SGGGGGYDVVENYTNNFLKRG

SEQ ID NO: 1791 - protein, 42 aa, Streptococcus mutans 2ST1
ASYLAMGTAALGGLACTTPVGAVLYLGAEVCAGAAVIYYGAN

SEQ ID NO: 1792 - protein, 19 aa, Streptococcus oralis (strain Uo5)
GIYQVGEAAGKTFYYITHP

SEQ ID NO: 1793 - protein, 23 aa, Pedobacter antarcticus 4BY
VGSAVAGGLAGYGLYKALDWALN

SEQ ID NO: 1794 - protein, 19 aa, Streptococcus tigurinus AZ_3a
GIYQVGEAAGKTFYYITHP

SEQ ID NO: 1795 - protein, 19 aa, Streptococcus mitis
GIYQVGEAAGKTFYYITHP

SEQ ID NO: 1796 - protein, 40 aa, Streptococcus pyogenes serotype M2 (strain MGAS10270)
NIGSAIGECLGGMLIAAAGGPITGGAAAFVCVASGIAAYQ

SEQ ID NO: 1797 - protein, 37 aa, Pseudomonas amygdali pv. tabaci str. ATCC 11528; identical to SEQ ID NO: 1723

SEQ ID NO: 1798 - protein, 41 aa, Bacillus cereus
GAGTGGLGGAAAGSAVPVIGTGIGGAIGGVSGGLTGAATFC

SEQ ID NO: 1799 - protein, 37 aa, Methylobacterium oryzae CBMB20
GAVSGVVGQAGSLVSGLVGSVLGAVGGLVGGVTGALR

SEQ ID NO: 1800 - protein, 38 aa, uncultured Bacteroidetes bacterium
AEQMQTVIGGGGGWSIIWEDPFDPRANDPTPPPPPGNG

SEQ ID NO: 1801 - protein, 30 aa, Psychroflexus gondwanensis ACAM 44
SLLAAMINDAQNNPDDFNAGVDAAPNPYNL

SEQ ID NO: 1802 - protein, 34 aa, Bacillus cereus BAG2O-2
MDTVAGGAQALGFTDGNCLATITADCTPWIGICS

SEQ ID NO: 1803 - protein, 34 aa, Bacillus cereus BAG1O-2; identical to SEQ ID NO: 1802

SEQ ID NO: 1804 - protein, 20 aa, Nostoc sp. (strain ATCC 29411 / PCC 7524)
GIGAALIGAGGAIIASDDSI

SEQ ID NO: 1805 - protein, 20 aa, Psychroflexus gondwanensis ACAM 44
GAGAGYGIAAGVDAIEGWFD

SEQ ID NO: 1806 - protein, 42 aa, Streptococcus mutans serotype c (strain ATCC 700610 / UA159); identical to SEQ ID NO: 1791

SEQ ID NO: 1807 - protein, 34 aa, Serratia sp. M24T3
AGAVGAASGALGALPGAFTTLESDVTGLEGSLLN

SEQ ID NO: 1808 - protein, 34 aa, Lactococcus lactis
GGVMESMNDVLKWLNGHSGSVTINNDSVYEIDFG

SEQ ID NO: 1809 - protein, 34 aa, Bacillus cereus HuB5-5
MDTVAGGAQALGFTDGNCLATITADCTDWLPICG

SEQ ID NO: 1810 - protein, 31 aa, Streptomyces lydicus A02
IGDVAGTAQSLAPQLPVSQFAGLVTVQSTDV

SEQ ID NO: 1811 - protein, 37 aa, Psychroflexus torquis (strain ATCC 700755 / ACAM 623)
LELVAGGCSSWTWSLLSGLICLGYQTAKHLDNCSCPG

SEQ ID NO: 1812 - protein, 37 aa, Calothrix sp. PCC 6303
NQLSSLFATGLAGIISGTQASEQQVNGFSFKDVNAGN

SEQ ID NO: 1813 - protein, 41 aa, Tolypothrix bouteillei VB521301
EQLESIFGGVKAEQPGLLLAYYWEYSEGGLFASPVADYGQS

SEQ ID NO: 1814 - protein, 38 aa, Synechococcus sp. RS9916
GGGFWKDVVNVAVGFTPLGPINRLSGALGGPTAGDLVE

SEQ ID NO: 1815 - protein, 23 aa, Chroococcidiopsis thermalis PCC 7203
AYADELVQLAAALDVDVETLLLQ

SEQ ID NO: 1816 - protein, 38 aa, Rothia aeria F0474
SYGGSYGGSYGGSNSSYYGGSYSGGGYYYAAVGYGYSC

SEQ ID NO: 1817 - protein, 38 aa, Rothia aeria F0184; identical to SEQ ID NO: 1816

SEQ ID NO: 1818 - protein, 16 aa, Pseudomonas savastanoi pv. glycinea str. race 4
AGASAIDAFQTYQMAQ

SEQ ID NO: 1819 - protein, 20 aa, Alteromonas sp. ALT199
GVIATGAALGAAWEYFTDDE

SEQ ID NO: 1820 - protein, 34 aa, Serratia sp. M24T3
YNEAINVGNQALKETDIFVAVSTQNLQTVFGGDI

SEQ ID NO: 1821 - protein, 13 aa, Calothrix sp. PCC 6303
NIDSFGEKFIQSF

SEQ ID NO: 1822 - protein, 35 aa, Bacillus cereus VD156
AGAATVGGLIGGPAGAFVGGVYGGVAYAIGVAADM

SEQ ID NO: 1823 - protein, 29 aa, Acinetobacter venetianus (strain ATCC 31012 / CIP 110063 / RAG-1)
GLGAAAGQAAGQIICPITNNGNSSEDGDG

SEQ ID NO: 1824 - protein, 36 aa, Bacillus cereus
GAGTVLGGLAGAGLGPGGIAAGISAGNMIAGMACSM

SEQ ID NO: 1825 - protein, 22 aa, Streptococcus infantis SK1302
KAIAGGTALVGSGLTAGYFLGG

SEQ ID NO: 1826 - protein, 22 aa, Streptococcus mitis
KAIAGGTALVGSGLAAGYFLGG

SEQ ID NO: 1827 - protein, 22 aa, Streptococcus oralis ATCC 35037
KAIAGGTALVGSGLAAGYFLGG

SEQ ID NO: 1828 - protein, 34 aa, Tatlockia micdadei (Legionella micdadei)
NDALNALDGLVNNPNLNTTAGNSNQQPILFNPYA

SEQ ID NO: 1829 - protein, 19 aa, Halobacteroides halobius (strain ATCC 35273 / DSM 5150 / MD-1)
GVWAAATTGGAALIQSAGY

SEQ ID NO: 1830 - protein, 23 aa, Streptococcus pneumoniae
KVIAGGTALIGSGLAAGYFLGGD

SEQ ID NO: 1831 - protein, 13 aa, Streptococcus sobrinus W1703
QVGSFARGVWDAF

SEQ ID NO: 1832 - protein, 22 aa, Streptococcus mitis
KAIAGGTALVGSGLAAGYFLGG

SEQ ID NO: 1833 - protein, 29 aa, Cystobacter fuscus DSM 2262
ETLETVVGGYSSDDGSGEPSEGPSCNTLC

SEQ ID NO: 1834 - protein, 16 aa, Streptococcus tigurinus 2426
STICTRMTGYGNGIIP

SEQ ID NO: 1835 - protein, 19 aa, Halobacteroides halobius (strain ATCC 35273 / DSM 5150 / MD-1)
AGIAALGTGIATTGSLVTD

SEQ ID NO: 1836 - protein, 12 aa, Streptococcus criceti HS-6
AVGAGAGALSDY

SEQ ID NO: 1837 - protein, 33 aa, Bacillus amyloliquefaciens (Bacillus velezensis)
MDTVAGGAQALGFTDGNCLATITADCTPWIWGC

SEQ ID NO: 1838 - protein, 16 aa, Streptococcus mitis
STICTRMTGYGNGIIP

SEQ ID NO: 1839 - protein, 29 aa, Acinetobacter pittii ANC 4050
GIGAAAGQAAGQIICPMTNNGNSSEDGDG

SEQ ID NO: 1840 - protein, 23 aa, Streptococcus pneumoniae PCS8203
KAIAGGTALIGSGLAAGYFLGGD

SEQ ID NO: 1841 - protein, 23 aa, Streptococcus pneumoniae serotype A19 (strain TCH8431)
KAIAGGTALIGSGLAAGYFLGGD

SEQ ID NO: 1842 - protein, 23 aa, Streptococcus pneumoniae PCS8106
KAIAGGTALIGSGLAAGYFLGGD

SEQ ID NO: 1843 - protein, 23 aa, Streptococcus mitis SK569
KAIAGGTALVGSGLAAGYFLGGD

SEQ ID NO: 1844 - protein, 23 aa, Streptococcus pneumoniae PNI0446
KAIAGGTALIGSGLAAGYFLGGD

SEQ ID NO: 1845 - protein, 23 aa, Streptococcus pneumoniae
KAIAGGTALIGSGLAAGYFLGGD

SEQ ID NO: 1846 - protein, 23 aa, Streptococcus pseudopneumoniae 22725
KAIAGGTALIGSGLAAGYFLGGD

SEQ ID NO: 1847 - protein, 23 aa, Streptococcus mitis 29/42
KAIAGGTALVGSGLAAGYFLGGD

SEQ ID NO: 1848 - protein, 23 aa, Streptococcus pseudopneumoniae 5247
KAIAGGTALIGSGLAAGYFLGGD

SEQ ID NO: 1849 - protein, 23 aa, Streptococcus pneumoniae GA47502
KAIAGGTALIGSGLAAGYFLGGD

SEQ ID NO: 1850 - protein, 23 aa, Streptococcus pneumoniae GA44500
KAIAGGTALIGSGLAAGYFLGGD

SEQ ID NO: 1851 - protein, 23 aa, Streptococcus pneumoniae GA41410
KAIAGGTALIGSGLAAGYFLGGD

SEQ ID NO: 1852 - protein, 23 aa, Streptococcus mitis (strain B6)
KAIAAGAALVGSGLAAGYFLGGD

SEQ ID NO: 1853 - protein, 23 aa, Streptococcus pneumoniae
KAIAGGTALIGSGLAAGYFLGGD

SEQ ID NO: 1854 - protein, 23 aa, Streptococcus pneumoniae
KVIAGGTALIGSGLAAGYFLGGD

SEQ ID NO: 1855 - protein, 23 aa, Streptococcus pneumoniae SP14-BS69
KAIAGGTALIGSGWAAGYFLGGD

SEQ ID NO: 1856 - protein, 23 aa, Streptococcus pneumoniae (strain JJA)
KAIAGGTALIGSGLAAGYFLGGD

SEQ ID NO: 1857 - protein, 23 aa, Streptococcus mitis 11/5
KAIAGGTALIGSGLAAGYFLGGD

SEQ ID NO: 1858 - protein, 23 aa, Streptococcus pseudopneumoniae (strain IS7493)
KAIAGGTALIGSGLAAGYFLGGD

SEQ ID NO: 1859 - protein, 23 aa, Streptococcus pneumoniae (strain ATCC BAA-255 / R6)
KAIAGGTALIGSGLAAGYFLGGD

SEQ ID NO: 1860 - protein, 23 aa, Streptococcus pneumoniae (strain 70585)
KAIAGGTALIGSGLAAGYFLGGD

SEQ ID NO: 1861 - protein, 23 aa, Streptococcus pneumoniae 2070335
KAIAGGTALIGSGLAAGYFLGGD

SEQ ID NO: 1862 - protein, 23 aa, Streptococcus pneumoniae (strain Hungary19A-6)
KAIAGGTALIGSGLAAGYFLGGD

SEQ ID NO: 1863 - protein, 23 aa, Streptococcus pneumoniae serotype 4 (strain ATCC BAA-334 / TIGR4)
KAIAGGTALIGSGLAAGYFLGGD

SEQ ID NO: 1864 - protein, 23 aa, Streptococcus pneumoniae serotype 2 (strain D39 / NCTC 7466)
KAIAGGTALIGSGLAAGYFLGGD

SEQ ID NO: 1865 - protein, 23 aa, Streptococcus pneumoniae SP6-BS73
KVIAGGTALIGSGLAAGYFLGGD

SEQ ID NO: 1866 - protein, 23 aa, Streptococcus pneumoniae (strain CGSP14)
KAIAGGTALIGSGLAAGYFLGGD

SEQ ID NO: 1867 - protein, 14 aa, Kitasatospora setae (strain ATCC 33774 / DSM 43861 / JCM 3304 / KCC A-0304 / NBRC 14216 / KM-6054) (Streptomyc es setae)
FSSVSNAVAEVAAE

SEQ ID NO: 1868 - protein, 23 aa, Streptococcus mitis
KAIAGGTALVGSGLAAGYFLGGD

SEQ ID NO: 1869 - protein, 21 aa, Streptococcus thermophilus CAG:236
AGGVLGGAGGTVAYGATCWWS

SEQ ID NO: 1870 - protein, 21 aa, Streptococcus thermophilus CNCM I-1630
AGGVLGGAGGTVAYGATCWWS

SEQ ID NO: 1871 - protein, 35 aa, [Eubacterium] rectale DSM 17629
GCAATGVGIGGAAGSVPGAVIGGAVGTIVGIMIAF

SEQ ID NO: 1872 - protein, 22 aa, Pelotomaculum thermopropionicum (strain DSM 13744 / JCM 10971 / SI)
GVGAVAGAALAGAVVGVTALVG

SEQ ID NO: 1873 - protein, 25 aa, Streptococcus thermophilus TH1435
GGLGAVGGPWGAVGGVLVGAALYCF

SEQ ID NO: 1874 - protein, 25 aa, Streptococcus thermophilus M17PTZA496
GGLGAVGGPWGAVGGVLVGAALYCF

SEQ ID NO: 1875 - protein, 25 aa, Streptococcus thermophilus TH1477
GGLGAVGGPWGAVGGVLVGAALYCF

SEQ ID NO: 1876 - protein, 25 aa, Streptococcus thermophilus JIM 8232
GGLGAVGGPWGAVGGVLVGAALYCF

SEQ ID NO: 1877 - protein, 25 aa, Pedobacter antarcticus 4BY
AAQVAGGAGAVFLAGMGIGAAVAAQ

SEQ ID NO: 1878 - protein, 36 aa, Pelotomaculum thermopropionicum (strain DSM 13744 / JCM 10971 / SI)
ALVGAGVALAAGAGVALAGAGALAAAILLPLYQNPD

SEQ ID NO: 1879 - protein, 14 aa, Streptomyces sp. PAMC 26508
GAVTGLASGLTAGL

SEQ ID NO: 1880 - protein, 14 aa, Streptomyces pratensis (strain ATCC 33331 / IAF-45CD)
GAVTGLASGLTAGL

SEQ ID NO: 1881 - protein, 34 aa, Streptomyces auratus AGR0001
VSGAVGTATGLVDGATGVNTSGVVGTATGLVSGL

SEQ ID NO: 1882 - protein, 28 aa, Streptomyces gancidicus BKS 13-15
GLVDTAVGTVEGVTGLNTAPVTNLVAGL

SEQ ID NO: 1883 - protein, 20 aa, Alteromonas mediterranea UM7
GAIATGAALGAAWEYFTDDE

SEQ ID NO: 1884 - protein, 20 aa, Alteromonas mediterranea 615
GAIATGAALGAAWEYFTDDE

---

The invention claimed is:

1. An isolated peptide comprising an amino acid sequence selected from the group consisting of FKVIVTDAGHYPREWGKQLGKWIGSKIK (SEQ ID NO: 5), KRNYSIEKYVKNY1DFIKKAIDIFRPMPI (SEQ ID NO: 6), KTIATNATYYPNKWAKSAGKWIASKIK (SEQ ID NO: 7), and QYDKTGYKIGKTVGTIVRKGFEIWSIFK (SEQ ID NO: 8), wherein the peptide is not longer than 45 amino acid residues in length.

2. The isolated peptide of claim 1, wherein the peptide has antimicrobial activity.

3. The isolated peptide of claim 1, wherein the peptide is not longer than 40 amino acid residues in length.

4. The isolated peptide of claim 1, wherein the peptide is not longer than 35 amino acid residues in length.

5. The peptide of claim 1, comprising one or more non-natural amino acid residue.

6. The composition comprising the peptide claim 1 and a pharmaceutically acceptable carrier.

7. The composition of claim 6, further comprising an antimicrobial agent.

8. The composition of claim 7, wherein the antimicrobial agent is selected from the group consisting of imipenem, ceftazidime, colistin, chloroquine, artemisinin, vancomycin and daptomycin.

9. A method of treating an infection in a patient in need thereof, comprising administering to the patient an effective amount of the peptide of claim 1 comprising an amino acid sequence of Table 2 or 3 or SEQ ID NO:328 1884 or an amino acid derived from a sequence of Table 2 or 3 or SEQ ID NO:328 1884 with one amino acid substitution.

10. The method of claim 9, wherein the infection is caused by a Gram-negative bacterium, a Gram-positive bacterium or a fungus.

* * * * *